US009283260B2

(12) United States Patent
Callahan et al.

(10) Patent No.: US 9,283,260 B2
(45) Date of Patent: Mar. 15, 2016

(54) LYOPHILIZED THERAPEUTIC PEPTIBODY FORMULATIONS

(75) Inventors: William J. Callahan, Thousand Oaks, CA (US); Richard L. Remmele, Jr., Camarillo, CA (US); Gayathri Ratnaswamy, Encino, CA (US); Ramil F. Latypov, Seattle, WA (US); Dingjiang Liu, Oak Park, CA (US)

(73) Assignee: AMGEN INC., Thousand Oaks, CA (US)

( * ) Notice: Subject to any disclaimer, the term of this patent is extended or adjusted under 35 U.S.C. 154(b) by 299 days.

(21) Appl. No.: 11/788,697

(22) Filed: Apr. 19, 2007

(65) Prior Publication Data

US 2009/0258017 A1 Oct. 15, 2009

Related U.S. Application Data

(63) Continuation of application No. 60/793,997, filed on Apr. 21, 2006.

(51) Int. Cl.
*A61K 39/395* (2006.01)
*A61K 38/10* (2006.01)
*A61K 9/19* (2006.01)
*A61K 38/16* (2006.01)

(52) U.S. Cl.
CPC . *A61K 38/10* (2013.01); *A61K 9/19* (2013.01); *A61K 38/16* (2013.01); *C07K 2319/30* (2013.01)

(58) Field of Classification Search
None
See application file for complete search history.

(56) References Cited

U.S. PATENT DOCUMENTS

| | | |
|---|---|---|
| 3,691,016 A | 9/1972 | Patel |
| 3,941,763 A | 3/1976 | Sarantakis |
| 3,969,287 A | 7/1976 | Jaworek et al. |
| 4,002,531 A | 1/1977 | Royer |
| 4,179,337 A | 12/1979 | Davis et al. |
| 4,195,128 A | 3/1980 | Hildebrand et al. |
| 4,229,537 A | 10/1980 | Hodgins et al. |
| 4,247,642 A | 1/1981 | Hirohara et al. |
| 4,330,440 A | 5/1982 | Ayers et al. |
| 4,904,584 A | 2/1990 | Shaw |
| 5,089,261 A | 2/1992 | Nitecki et al. |
| 5,223,409 A | 6/1993 | Ladner et al. |
| 5,252,714 A | 10/1993 | Harris et al. |
| 5,281,698 A | 1/1994 | Nitecki |
| 5,338,665 A | 8/1994 | Schatz et al. |
| 5,362,852 A | 11/1994 | Geoghegan |
| 5,428,130 A | 6/1995 | Capon et al. |
| 5,432,018 A | 7/1995 | Dower et al. |
| 5,498,530 A | 3/1996 | Schatz et al. |
| 5,608,035 A | 3/1997 | Yanofsky et al. |
| 5,733,731 A | 3/1998 | Schatz et al. |
| 5,739,277 A | 4/1998 | Presta et al. |
| 5,773,569 A | 6/1998 | Wrighton et al. |
| 5,786,331 A | 7/1998 | Barrett et al. |
| 5,824,784 A | 10/1998 | Kinstler et al. |
| 5,834,594 A | 11/1998 | Hakimi et al. |
| 5,869,451 A | 2/1999 | Dower et al. |
| 5,880,096 A | 3/1999 | Barrett et al. |
| 5,922,545 A | 7/1999 | Mattheakis et al. |
| 5,932,946 A | 8/1999 | Miyasaka et al. |
| 5,985,265 A | 11/1999 | Kinstler et al. |
| 6,171,586 B1 | 1/2001 | Lam et al. |
| 6,423,685 B1 | 7/2002 | Drummond et al. |
| 6,433,135 B1 | 8/2002 | El-Tayar et al. |
| 6,586,398 B1 | 7/2003 | Kinstler et al. |
| 6,635,646 B1 | 10/2003 | Laughlin |
| 6,660,843 B1 * | 12/2003 | Feige et al. ................. 530/391.7 |
| 6,800,735 B2 | 10/2004 | Whitty et al. |
| 6,835,809 B1 | 12/2004 | Liu et al. |
| 7,166,707 B2 | 1/2007 | Feige |
| 7,169,905 B2 | 1/2007 | Feige |
| 7,186,810 B2 | 3/2007 | Feige |
| 7,189,827 B2 | 3/2007 | Feige |
| 7,442,778 B2 * | 10/2008 | Gegg et al. ................. 530/391.7 |
| 7,488,590 B2 | 2/2009 | Feige et al. |
| 7,994,117 B2 | 8/2011 | Liu et al. |
| 8,044,174 B2 | 10/2011 | Liu et al. |
| 8,618,044 B2 | 12/2013 | Liu et al. |
| 8,748,571 B2 | 6/2014 | Liu et al. |
| 2003/0096400 A1 | 5/2003 | Kinstler |
| 2003/0176352 A1 | 9/2003 | Min et al. |
| 2003/0195156 A1 | 10/2003 | Min et al. |
| 2003/0229023 A1 | 12/2003 | Oliner et al. |
| 2003/0236193 A1 | 12/2003 | Oliner et al. |
| 2004/0071712 A1 | 4/2004 | Feige et al. |
| 2004/0077022 A1 | 4/2004 | Feige et al. |

(Continued)

FOREIGN PATENT DOCUMENTS

| | | |
|---|---|---|
| EP | 0 124 961 A2 | 11/1984 |
| EP | 0 154 316 | 9/1985 |

(Continued)

OTHER PUBLICATIONS

Liao et al., Influence of the Active Pharmaceutical Ingredient Concentration on the Physical State of Mannitol—Implications in Freeze-Drying, Pharmaceutical Research, Nov. 2005, pp. 1978-1985, vol. 22, No. 11.
Beauchamp et al, "A New Procedure for the Synthesis of Polyethylene Glycol-Protein Adducts ; Effects on Function, Receptor Recognition, and Clearance of Superoxide Dismutase, Lactoferrin, and α2-Macroglobulin," Anal. Biochem., 131:25-33 (1983).
Bhatnagar et al., Structure-Activity Relationships of Novel Hematoregulatory Peptides, J. Med. Chem., 39:3814-3819 (1996).
Cacace et al., "The Hofmeister Series: Salt and Solvent Effects on Interfacial Phenomena," Quarterly Reviews of Biophysics, 30(3) : 241-277 (1997).
Capon et al., "Designing CD4 Immunoadhesins for AIDS Therapy," Nature, 337:525-531 (1989).
Carpenter et al., "Interactions of Stabilizing Additives with Proteins During Freeze-Thawing and Freeze-Drying," Develop. Biol. Standard, 74:225-239 (1991).
Chang et al., "Development of a Stable Freeze-dried Formulation of Recombinant Human Interleukin-1 Receptor Antagonist," Pharm Res., 13(2):243-249 (1996).

(Continued)

Primary Examiner — Yunsoo Kim
(74) Attorney, Agent, or Firm — Timothy J. Gaul

(57) ABSTRACT

The present invention provides long-term stable formulations of a lyophilized therapeutic peptibody and methods for making a lyophilized composition comprising a therapeutic peptibody.

8 Claims, No Drawings

(56) References Cited

U.S. PATENT DOCUMENTS

| 2004/0181033 | A1 | 9/2004 | Han et al. |
| 2006/0140934 | A1 | 6/2006 | Gegg et al. |
| 2006/0189531 | A1 | 8/2006 | Liu et al. |
| 2007/0142295 | A1 | 6/2007 | Liu et al. |
| 2015/0024431 | A1 | 1/2015 | Liu et al. |

FOREIGN PATENT DOCUMENTS

| EP | 0 315 456 | | 5/1989 |
| EP | 0 401 384 | | 12/1990 |
| EP | 0 442 724 | A2 | 8/1991 |
| EP | 0 539 167 | A2 | 4/1993 |
| EP | 0 911 393 | | 4/1999 |
| RU | 2180233 | C1 | 3/2002 |
| WO | WO 90/04606 | | 5/1990 |
| WO | WO 90/07938 | | 7/1990 |
| WO | WO 92/16221 | | 10/1992 |
| WO | WO 94/13322 | | 6/1994 |
| WO | WO 95/14714 | | 6/1995 |
| WO | WO 96/05309 | | 2/1996 |
| WO | WO 96/11953 | | 4/1996 |
| WO | WO 96/24369 | A1 | 8/1996 |
| WO | WO 96/32478 | | 10/1996 |
| WO | WO 96/40772 | | 12/1996 |
| WO | WO 96/40987 | | 12/1996 |
| WO | WO 97/04801 | A1 | 2/1997 |
| WO | WO 97/08203 | | 3/1997 |
| WO | WO 97/23614 | | 7/1997 |
| WO | WO 97/34631 | | 9/1997 |
| WO | WO 97/40070 | | 10/1997 |
| WO | WO 98/09985 | | 3/1998 |
| WO | WO 98/14476 | A1 | 4/1998 |
| WO | WO 98/15833 | | 4/1998 |
| WO | WO 98/46751 | | 10/1998 |
| WO | WO 98/53842 | | 12/1998 |
| WO | WO 99/47151 | | 9/1999 |
| WO | WO 00/24770 | | 5/2000 |
| WO | WO00/24782 | A2 | 5/2000 |
| WO | WO 00/47740 | | 8/2000 |
| WO | WO 01/83525 | A2 | 11/2001 |
| WO | 2004/019860 | A2 | 3/2004 |
| WO | WO 2004/026329 | | 4/2004 |
| WO | WO 2004/039337 | | 5/2004 |
| WO | WO 2004/058988 | | 7/2004 |
| WO | WO 2004/092215 | A2 | 10/2004 |
| WO | WO 2006/010057 | | 1/2006 |

OTHER PUBLICATIONS

Chang et al., "Surface-Induced Denaturation of Proteins during Freezing and Its Inhibition by Surfactants," J., Pharm. Sci., 85(12):1325-1330 (1996).
Chen et al., "Influence of Calcium Ions on the Structure and Stability of Recombinant Human Deoxyribonuclease I in the Aqueous and Lyophilized States," J. Pharm Sci., 88(4) : 477-482 (1999).
Chen et al., "Influence of Histidine on the Stability and Physical Properties of a Fully Human Antibody in Aqueous and Solid Forms," Pharm Res., 20(12) : 1952-1960 (2003).
Chen, Tracy, "Formulation Concerns of Protein Drugs," Drug Development and Industrial Pharmacy, 18:1311-1354 (1992).
Chevalier F. et al., "Maillard Glycation of β-lactoglobulin Induces Conformation Changes," Nahrung/Food, 46(2): 58-63 (2002).
Clackson et al., "A Hot Spot of Binding Energy in a Hormone-Receptor Interface," Science, 267: 383-386 (1995).
Conforti et al., "PEG Superoxide Dismutase Derivatives: Anti-Inflammatory Activity in Carrageenan Pelurisy in Rats," Pharm. Research Commun., vol. 19(4):287-294 (1987).
Cortese et al., "Selection of Biologically Active Peptides by Phage Display of Random Peptide Libraries," Curr. Opin. Biotech., 7:616-621 (1996).
Cuthbertson et al., "Design of Low Molecular Weight Hematoregulatory Agents from the Structure-Activity Relationship of a Dimeric Pentapeptide," J. Med. Chem., 40:2876-2882 (1997).
Cwirla et al., "Peptide Agonist of the Thrombopoietin Receptor as Potent as the Natural Cytokine," Science, 276:1696-1699 (1997).
Davis et al., "Preparation and Characterization of Antibodies with Specificity for the Amino-Terminal Tetrapeptide Sequence of the Platelet-Derived Connective Tissue Activating Peptide-III," Biochem. Intl., 10(3):394-404 (1985).
Dedman et al., "Selection of Targeted Biological Modifiers from a Bacteriophage Library of Random Peptides," J. Biol. Chem., 268(31): 23025-23030 (1993).
Delgado et al., "Coupling of PEG to Protein by Activation With Tresyl Chloride, Applications in Immunoaffinity Cell Partitioning," Fisher et al., eds., Separations Using Aqueous Phase Systems, Applications in Cell Biology and Biotechnology, Plenum Press, N.Y. N.Y., 211-213 (1989).
Derrick et al., "Effect of Metal Cations on the Conformation and Inactivation of Recombinant Human Factor VIII," J. Pharm. Sci., 93(10) : 2549-2557 (2004).
Devlin et al., "Random Peptide Libraries: A Source of Specific Protein Binding Molecules," Science, 249:404-406 (1990).
Abuchowski et al., "Effect of Covalent Attachment of Polyethylene Glycol on Immunogenicity and Circulating Life of Bovine Liver Catalase," J. Biol. Chem, 252(11):3582-3586 (1977).
Akers et al., "Peptides and Proteins as Parenteral Solutions, Pharmaceutical Formulation Development of Peptides and Proteins," Sven Frokjaer, Lars Hovgaard, eds, Pharmaceutical Science, Taylor and Francis, UK, 8:145-177 (1999).
Alberts et al., "Synthesis of a Novel Hematopoietic Peptide, SK&F 107647," Thirteenth Am. Pep. Symp., 367-369 (1993).
Ellison et al., "The Nucleotide Sequence of a Human Immunoglobulin $C_{\gamma 1}$ gene," Nucleic Acids Res., 10(13): 4071-4079 (1982).
Erickson et al., "Solid-Phase Peptide Synthesis," The Proteins, 3rd Ed., 2:257-517 (1976).
Fairbrother et al., "Novel Peptides Selected to Bind Vascular Endothelial Growth Factor Target the Receptor-Binding Site," Biochem., 37:17754-17764 (1998).
Fatouros et al., "Recombinant Factor VIII SQ-Influence of Oxygen, Metal Ions, pH and Ionic Strength on its Aqueous Solution," Int. J. Pharm., 155:121-131 (1997).
Fields et al., "A Spectrophotometric Method for the Microdetermination of Periodate," Biochem J., 108:883-887 (1968).
Finn et al., "The Synthesis of Peptides by Solution Methods with Emphasis on Peptide Hormones," The Proteins, 3rd Ed., 2:105-253 (1976).
Francis, Gillian E., "Protein Modification and Fusion Proteins," Focus on Growth Factors, 3:4-10, (1992).
Francis et al., "PEG-Modified Proteins," Stability of protein pharmaceuticals: Part B in vivo pathways of degradation and strategies for protein stabilization, Eds. Ahern., T. Manning, M.C., Plenum, N.Y., pp. 235-263 (1991).
Fransson J.R., "Oxidation of Human Insulin-Like Growth Factor I in Formulation Studies. 3. Factorial Experiments of the Effects of Ferric Ions, EDTA, and Visible Light on Methionine Oxidation and Covalent Aggregation in Aqueous Solution," J. Pharm. Sci., 86(9):1046-1050 (1997).
Fukumoto et al., "Peptide Mimics of the CTLA4-binding Domain Stimulate T-cell Proliferation," Nature Biotech., 16:267-270 (1998).
Gaertner et al., "Construction of Protein Analogues by Site-Specific Condensation of Unprotected Fragments," Bioconjugate Chem., 3:262-268 (1992).
Gaertner et al., "Chemo-enzymic Backbone Engineering of Proteins," J. Biol. Chem., 269(10):7224-7230 (1994).
Geoghegan et al., "Site-Directed Conjugation of Nonpeptide Groups to Peptides and Proteins via Periodate Oxidation of a 2-Amino Alcohol. Application to Modification at N-Terminal Serine," Bioconjugate Chem., 3:138-146 (1992).
Greenwald et al., "Poly(ethylene glycol) Conjugated Drugs and Prodrugs: A Comprehensive Review," Crit Rev Therap Drug Carrier Syst, 17(2):101-161 (2000).
Harris et al., "Pegylation, A Novel Process for Modifying Pharmacokinetics," Clin Pharmacokinet, 40(7): 539-551 (2001).
Hollander-Rodriguez et al., "Hyperkalemia," Am. Fam. Physician., 73(2): 283-290 (2006).

(56) References Cited

OTHER PUBLICATIONS

Humeny A. et al., "Qualitative Determination of Specific Protein Glycation Products by Matrix-Assisted Laser Desorption/Ionization Mass Spectrometry Peptide Mapping," J. Agric Food Chem., 50: 2153-2160 (2002).
Inglot, Anna D., "Classification of Cytokines According to the Receptor Code," Archivum Immunologiae et Therapiae Experimentalis, 45:353-357 (1997).
Ishikawa et al., "Gd1α-Replica Peptides Functionally Mimic Gd1α, An Adhesion Molecule of Metastic Tumor Cells, and Suppress the Tumor Metastasis," FEBS Lett., 441: 20-24 (1998).
Kappelgaard et al., "Liquid Growth Hormone: Preservatives and Buffers," Horm Res., 62(Suppl 3):98-103 (2004).
Katre et al., "Chemical Modification of Recombinant Interleukin 2 by Polyethylene Glycol Increases its Potency in the Murine Meth A Sarcoma Model," Proc. Natl. Acad. Sci. U.S.A., vol. 84: 1487-1491 (1987).
Kautz et al., "The Hydrolsis of Sucrose by Hydrochloric Acid in the Presence of Alkali and Alkaline earth Chlorides," JACS, 50(4), 1022-1030 (1928).
Kay et al., "From Peptides to Drugs via Phage Display," Drug Disc. Today, 3(8):370-378 (1998).
Koivunen et al., "Tumor Targeting with a Selective Gelatinase Inhibitor," Nature Biotech., 17:768-774 (1999).
Kopeček et al., "Water Soluble Polymers in Tumor Targeted Delivery," J. Controlled Release, 74:147-158 (2001).
Kreeger, Karen Y., "Immunological Applications Top List of Peptide-Synthesis Services," The Scientist, 10(13): 18-20 (1996).
Lam et al., "Antioxidants for Prevention of Methionine Oxidation in Recombinant Monoclonal Antibody HER2," J. Pharm Sci., 86(11):1250-1255 (1997).
Laursen et al., "Pain Perception after Subcutaneous Injections of Media Containing Different Buffers," Basic Clin Pharmacol Toxicol, 98: 218-21 (2006).
Lee et al., "Thermal Stability of Proteins in the Presence of Poly(ethylene glycols)," Biochemistry, 26: 7813-7819 (1987).
Lehninger, Albert L., "The Molecular Basis of Cell Structure and Function," Biochemistry, 2nd Edition, Worth Publishers, Inc., New York, 71-77 (1975).
Liu et al., "Reversible Self-Association Increases the Viscosity of a Concentrated Monoclonal Antibody in Aqueous Solution," J. Pharm Sci., 94(9) : 1928-1940 (2005).
Liu et al., "Reversible Self-Association Increases the Viscosity of a Concentrated Monoclonal Antibody in Aqueous Solution," J. Pharm Sci., 95(1) : 234-235 (2006).
Lowman, H.B., "Bacteriophage Display and Discovery of Peptide Leads for Drug Development," Ann. Rev. Biophys. Biomol. Struct., 26: 401-424 (1997).
MacKenzie et al., "Non-Equilibrium Freezing Behaviour of Aqueous Systems [and Discussion]," Phil Trans R Soc London, Ser B, Biol, 278:167-189 (1977).
Merrifield, R.B., "Solid-Phase Peptide Synthesis," Chem Polypeptides, Katsoyannis and Panayotis eds., pp. 335-361 (1973).
Merrifield, R.B., "Solid Phase Peptide Synthesis. I. The Synthesis of a Tetrapeptide," J. Am. Chem, Soc., 85: 2149-2154 (1963).
Minogue et al., "Bacteriostatic Saline Containing Benzyl Alcohol Decreases the Pain Associated with the Injection of Propofol," Anesth Analg., 100:683-686 (2005).
Naranda et al., "Activation of Erythropoietin Receptor in the Absence of Hormone by a Peptide that Binds to a Domain Different from the Hormone Binding Site," Proc. Natl. Acad. Sci. USA, 96:7569-7574 (1999).
Nathan et al., "Copolymers of Lysine and Polyethylene Glycol: A New Family of Functionalized Drug Carriers," Bioconj Chem., 4:54-62 (1993).
Nathan et al., "Hydrogels Based on Water-Soluble Poly(ether urethanes) Derived from L-Lysine and Poly(ethylene glycol)," Macromolecules, 25:4476-4484 (1992).

Paukovits et al., "Structural Investigations on a Peptide Regulating Hemopoiesis in vitro and in vivo," Hoppe-Seyler's Z. Physiol. Chem., 365:303-311 (1984).
Powell et al., "Compendium of Excipients for Parenteral Formulations," PDA J. Pharm. Sci. Technology, 52:238-311 (1998).
Randolph et al., "Surfactant-Protein Interactions," Pharm Biotechnol., 13:159-175 (2002).
Ravin et al., "Preformulation," Remington's Pharmaceutical Sciences, 18th Ed., Mack Publishing Co., Easton, PA 18042, 75:1435-1712 (1990).
Remmele et al., "Minimization of Recombinant Human Flt3 Ligand Aggregation at the $T_m$ Plateau: A Matter of Thermal Reversibility," Biochemistry, 38:5241-5247 (1999).
Remmele et al., "Interleukin-1 Receptor(IL-1R) Liquid Formulation Development Using Differential Scanning Calorimetry," Pharm. Res., 15(2) : 200-208 (1998).
Roberts et al., "RNA-Peptide Fusions for the in vitro Selection of Peptides and Proteins," Proc. Natl. Acad. Sci. USA, 94:12297-12302 (1997).
Roy et al., "Effects of Benzyl Alcohol on Aggregation of recombinant Human Interleukin-1-Receptor Antagonist in Reconstituted Lyophilized Formulations," J. Pharm Sci., 94(2) : 382-396 (2005).
Sarmay et al., "Mapping and Comparison of the Interaction Sites on the Fc Region of IgG Responsible for Triggering Antibody Dependent Cellular Cytotoxicity (ADCC) Through Different Types of Human Fcγ Receptor," Molecular Immunology, 29(5):633-639 (1992).
Scott et al., "Searching for Peptide Ligands with an Epitope Library," Science, 249:386-390 (1990).
Smith et al., "Isolation of Glucagon Antagonists by Random Molecular Mutagenesis and Screening," Mol. Pharmacol. 43: 741-748 (1993).
Sparks et al., "Distinct Ligand Preferences of Src Homology 3 Domains from Src, Yes, Abl, Cortactin, p53bp2, PLCγ, Crk, and Grb2," Proc. Natl. Acad. Sci., 93:1540-1544 (1996).
Suzuki et al., "Physicochemical and Biological Properties of Poly-(ethylene Glycol)-Coupled Immunoglobulin G," Biochem. Biophys. Acta, vol. 788:248-255 (1984).
Takasaki et al., "Structure-based Design and Characterization of Exocyclic Peptidomimetics that Inhibit TNFαBinding to its Receptor," Nature Biotech., 15:1266-1270 (1997).
Tang et al., "Design of Freeze-Drying Processes for Pharmaceuticlas:Practical Advice," Pharm Res., 21(2):191-200 (2004).
Tomita et al., "Sensitized Photooxidation of Histidine and Its Derivatives. Products and Mechanism of the Reaction," Biochemistry, 8(12) 5149-5160 (1969).
Uto, I., et al. "Determination of Urinary Tamm-Horsfall Protein by ELISA using a Maleimide Method for Enzyme-Antibody Conjugation," J. Immunol. Methods 138, 87-94 (1991).
Veronese et al., "Surface Modification of Proteins, Activation of Monomethoxy-Polyethylene Glycols by Phenylchloroformates and Modification of Ribonuclease and Superoxide Dismutase," Appll. Biochem. and Biotech., 11:141-152 (1985).
Wells et al., "Rapid Evolution of Peptide and Protein Binding Properties in vitro," Curr. Opin. Biotechnol., 3:355-362 (1992).
Wilson et al., "Phage Display: Applications, Innovations, and Issues in Phage and Host Biology," Can. J. Microbiol., 44:313-329 (1998).
Wrighton et al., "Small Peptides as Potent Mimetics of the Protein Hormone Erythropoietin," Science, 273:458-463 (1996).
Yin et al., "Effects of Antioxidants on the Hydrogen Peroxide-Mediated Oxidation of Methionine Residues in Granulocyte Colony-Stimulating Factor and Human Parathyroid Hormone Fragment 13-34," Pharm Res., 21(12):2377-2383 (2004).
Zalipsky et al., "Poly(ethylene glycol)-Grafted Liposomes with Oligopeptide or Oligosaccharide Ligands Appended to the Termini of the Polymer Chains," Bioconjug Chem., 8:111-118 (1997).

\* cited by examiner

LYOPHILIZED THERAPEUTIC PEPTIBODY FORMULATIONS

This application claims benefit under 35 U.S.C. §119 of U.S. Provisional Patent Application Ser. No. 60/793,997, which was filed Apr. 21, 2006, which is incorporated herein by reference in its entirety.

FIELD OF THE INVENTION

Generally, the invention relates to formulations of lyophilized therapeutic peptibodies and methods for making a lyophilized composition comprising therapeutic peptibodies.

The instant application contains an ASCII "txt" compliant sequence listing submitted via EFS-WEB on May 6, 2010, which serves as both the computer readable form (CRF) and the paper copy required by 37 C.F.R. Section 1.821(c) and 1.821(e), and is hereby incorporated by reference in its entirety. The name of the "txt" file created on May 6, 2010, is: A-1122-US-NP 20100506 Seq_List.txt., and is 532 KB in size.

BACKGROUND OF THE INVENTION

Recombinant proteins are an emerging class of therapeutic agents. Such recombinant therapeutics have engendered advances in protein formulation and chemical modification. Modifications have been identified that can protect therapeutic proteins, primarily by blocking their exposure to proteolytic enzymes. Protein modifications may also increase the therapeutic protein's stability, circulation time, and biological activity. A review article describing protein modification and fusion proteins is Francis (1992), Focus on Growth Factors 3:4-10 (Mediscript, London), which is hereby incorporated by reference.

One useful modification is combination of a polypeptide with an "Fc" domain of an antibody. Antibodies comprise two functionally independent parts, a variable domain known as "Fab," which binds antigen, and a constant domain known as "Fc," which links to such effector functions as complement activation and attack by phagocytic cells. An Fc has a long serum half-life, whereas an Fab is short-lived. Capon et al. (1989), Nature 337: 525-31. See also, e.g., U.S. Pat. No. 5,428,130. When constructed together with a therapeutic peptibody or protein, an Fc domain can provide longer half-life or incorporate such functions as Fc receptor binding, protein A binding, complement fixation and perhaps even placental transfer. Id. Table 1 summarizes use of Fc fusions with therapeutic proteins known in the art.

TABLE 1

Fc fusion with therapeutic proteins

| Form of Fc | Fusion partner | Therapeutic implications | Reference |
| --- | --- | --- | --- |
| IgG1 | N-terminus of CD30-L | Hodgkin's disease; anaplastic lymphoma; T-cell leukemia | U.S. Pat. No. 5,480,981 |
| Murine Fcγ2a | IL-10 | anti-inflammatory; transplant rejection | Zheng et al. (1995), J. Immunol. 154: 5590-600 |
| IgG1 | TNF receptor | septic shock | Fisher et al. (1996), N. Engl. J. Med. 334: 1697-1702; Van Zee, K. et al. (1996), J. Immunol. 156: 2221-30 |
| IgG, IgA, IgM, or IgE (excluding the first domain) | TNF receptor | inflammation, autoimmune disorders | U.S. Pat. No. 5,808,029, issued Sep. 15, 1998 |
| IgG1 | CD4 receptor | AIDS | Capon et al. (1989), Nature 337: 525-31 |
| IgG1, IgG3 | N-terminus of IL-2 | anti-cancer, antiviral | Harvill et al. (1995), Immunotech. 1: 95-105 |
| IgG1 | C-terminus of OPG | osteoarthritis; bone density | WO 97/23614, published Jul. 3, 1997 |
| IgG1 | N-terminus of leptin | anti-obesity | PCT/US 97/23183, filed Dec. 11, 1997 |
| Human Ig Cγ1 | CTLA-4 | autoimmune disorders | Linsley (1991), J. Exp. Med. 174: 561-9 |

Polyethylene glycol ("PEG") conjugated or fusion proteins and peptides have also been studied for use in pharmaceuticals, on artificial implants, and other applications where biocompatibility is of importance. Various derivatives of PEG have been proposed that have an active moiety for permitting PEG to be attached to pharmaceuticals and implants and to molecules and surfaces generally. For example, PEG derivatives have been proposed for coupling PEG to surfaces to control wetting, static buildup, and attachment of other types of molecules to the surface, including proteins or protein residues.

In other studies, coupling of PEG ("PEGylation") has been shown to be desirable in overcoming obstacles encountered in clinical use of biologically active molecules. Published PCT Publication No. WO 92/16221 states, for example, that many potentially therapeutic proteins have been found to have a short half life in blood serum.

PEGylation decreases the rate of clearance from the bloodstream by increasing the apparent molecular weight of the molecule. Up to a certain size, the rate of glomerular filtration of proteins is inversely proportional to the size of the protein. The ability of PEGylation to decrease clearance, therefore, is generally not a function of how many PEG groups are attached to the protein, but the overall molecular weight of the conjugated protein. Decreased clearance can lead to increased efficacy over the non-PEGylated material. See, for example, Conforti et al., Pharm. Research Commun. vol. 19, pg. 287 (1987) and Katre et., Proc. Natl. Acad. Sci. U.S.A. vol. 84, pg. 1487 (1987).

In addition, PEGylation can decrease protein aggregation, (Suzuki et al., Biochem. Biophys. Acta vol. 788, pg. 248 (1984)), alter (i.e.) protein immunogenicity (Abuchowski et al., J. Biol. Chem. vol. 252 pg. 3582 (1977)), and increase protein solubility as described, for example, in PCT Publication No. WO 92/16221.

In general, the interaction of a protein ligand with its receptor often takes place at a relatively large interface. However, as demonstrated in the case of human growth hormone bound to its receptor, only a few key residues at the interface actually contribute to most of the binding energy. Clackson, T. et al., Science 267:383-386 (1995). This observation and the fact that the bulk of the remaining protein ligand serves only to display the binding epitopes in the right topology makes it possible to find active ligands of much smaller size. Thus, molecules of only "peptide" length as defined herein can bind to the receptor protein of a given large protein ligand. Such peptides may mimic the bioactivity of the large protein ligand ("peptide agonists") or, through competitive binding, inhibit the bioactivity of the large protein ligand ("peptide antagonists").

Phage display peptide libraries have emerged as a powerful method in identifying such peptide agonists and antagonists. See, for example, Scott et al. (1990), Science 249: 386; Devlin et al. (1990), Science 249: 404; U.S. Pat. No. 5,223,409, issued Jun. 29, 1993; U.S. Pat. No. 5,733,731, issued Mar. 31, 1998; U.S. Pat. No. 5,498,530, issued Mar. 12, 1996; U.S. Pat. No. 5,432,018, issued Jul. 11, 1995; U.S. Pat. No. 5,338,665, issued Aug. 16, 1994; U.S. Pat. No. 5,922,545, issued Jul. 13, 1999; WO 96/40987, published Dec. 19, 1996; and WO 98/15833, published Apr. 16, 1998, each of which is incorporated by reference. In such libraries, random peptide sequences are displayed by fusion with coat proteins of filamentous phage. Typically, the displayed peptides are affinity-eluted against an antibody-immobilized extracellular domain of a receptor. The retained phages may be enriched by successive rounds of affinity purification and repropagation, and the best binding peptides are sequenced to identify key residues within one or more structurally related families of peptides. See, e.g., Cwirla et al. (1997), Science 276: 1696-9, in which two distinct families were identified. The peptide sequences may also suggest which residues may be safely replaced by alanine scanning or by mutagenesis at the DNA level. Mutagenesis libraries may be created and screened to further optimize the sequence of the best binders. Lowman (1997), Ann. Rev. Biophys. Biomol. Struct. 26: 401-24.

Other methods compete with phage display in peptide research. A peptide library can be fused to the carboxyl terminus of the lac repressor and expressed in E. coli. Another E. coli-based method allows display on the cell's outer membrane by fusion with a peptidoglycan-associated lipoprotein (PAL). These and related methods are collectively referred to as "E. coli display." Another biological approach to screening soluble peptide mixtures uses yeast for expression and secretion. See Smith et al. (1993), Mol. Pharmacol. 43: 741-8. The method of Smith et al. and related methods are referred to as "yeast-based screening." In another method, translation of random RNA is halted prior to ribosome release, resulting in a library of polypeptides with their associated RNA still attached. This and related methods are collectively referred to as "ribosome display." Other methods employ chemical linkage of peptides to RNA; see, for example, Roberts & Szostak (1997), Proc. Natl. Acad. Sci. USA, 94: 12297-303. This and related methods are collectively referred to as "RNA-peptide screening." Chemically derived peptide libraries have been developed in which peptides are immobilized on stable, non-biological materials, such as polyethylene rods or solvent-permeable resins. Another chemically derived peptide library uses photolithography to scan peptides immobilized on glass slides. These and related methods are collectively referred to as "chemical-peptide screening." Chemical-peptide screening may be advantageous in that it allows use of D-amino acids and other unnatural analogues, as well as non-peptide elements. Both biological and chemical methods are reviewed in Wells & Lowman (1992), Curr. Opin. Biotechnol. 3: 355-62.

In the case of known bioactive peptides, rational design of peptide ligands with favorable therapeutic properties can be carried out. In such an approach, stepwise changes are made to a peptide sequence and the effect of the substitution upon bioactivity or a predictive biophysical property of the peptide (e.g., solution structure) is determined. These techniques are collectively referred to as "rational design." In one such technique, a series of peptides is made in which a single residue at a time is replaced with alanine. This technique is commonly referred to as an "alanine walk" or an "alanine scan." When two residues (contiguous or spaced apart) are replaced, it is referred to as a "double alanine walk." The resultant amino acid substitutions can be used alone or in combination to result in a new peptide entity with favorable therapeutic properties.

Structural analysis of protein-protein interaction may also be used to suggest peptides that mimic the binding activity of large protein ligands. In such an analysis, the crystal structure may suggest the identity and relative orientation of critical residues of the large protein ligand, from which a peptide may be designed. See, e.g., Takasaki et al. (1997), Nature Biotech. 15: 1266-70. These and related methods are referred to as "protein structural analysis." These analytical methods may also be used to investigate the interaction between a receptor protein and peptides selected by phage display, which may suggest further modification of the peptides to increase binding affinity.

Conceptually, peptide mimetics of any protein can be identified using phage display and the other methods mentioned above. These methods have also been used for epitope mapping, for identification of critical amino acids in protein-protein interactions, and as leads for the discovery of new therapeutic agents. E.g., Cortese et al. (1996), Curr. Opin. Biotech. 7: 616-21. Peptide libraries are now being used most often in immunological studies, such as epitope mapping. Kreeger (1996), The Scientist 10(13): 19-20.

Of particular interest is use of peptide libraries and other techniques in the discovery of pharmacologically active peptides. A number of such peptides identified in the art are summarized in Table 2. The peptides are described in the listed publications, each of which is hereby incorporated by reference. The pharmacologic activity of the peptides is described, and in many instances is followed by a shorthand term therefor in parentheses. Some of these peptides have been modified (e.g., to form C-terminally cross-linked dimers). Typically, peptide libraries were screened for binding to a receptor for a pharmacologically active protein (e.g., EPO receptor). In at least one instance (CTLA4), the peptide library was screened for binding to a monoclonal antibody.

TABLE 2

Pharmacologically active peptides

| Form of peptide | Binding partner/ protein of interest[1] | Pharmacologic activity | Reference |
|---|---|---|---|
| intrapeptide disulfide-bonded | EPO receptor | EPO-mimetic | Wrighton et al. (1996), Science 273: 458-63; U.S. Pat. No. 5,773,569, issued Jun. 30, 1998 to Wrighton et al. |
| C-terminally cross-linked dimer | EPO receptor | EPO-mimetic | Livnah et al. (1996), Science 273: 464-71; Wrighton et al. (1997), Nature Biotechnology 15: 1261-5; International patent application WO 96/40772, published Dec. 19, 1996 |
| linear | EPO receptor | EPO-mimetic | Naranda et al. (1999), Proc. Natl. Acad. Sci. USA, 96: 7569-74; WO 99/47151, published Sep. 23, 1999 |
| linear | c-Mpl | TPO-mimetic | Cwirla et al.(1997) Science 276: 1696-9; U.S. Pat. No. 5,869,451, issued Feb. 9, 1999; U.S. Pat. No. 5,932,946, issued Aug. 3, 1999 |
| C-terminally cross-linked dimer | c-Mpl | TPO-mimetic | Cwirla et al. (1997), Science 276: 1696-9 |
| disulfide-linked dimer | | stimulation of hematopoiesis ("G-CSF-mimetic") | Paukovits et al. (1984), Hoppe-Seylers Z. Physiol. Chem. 365: 303-11; Laerum et al. (1988), Exp. Hemat. 16: 274-80 |
| alkylene-linked dimer | | G-CSF-mimetic | Bhatnagar et al. (1996), J. Med. Chem. 39: 3814-9; Cuthbertson et al. (1997), J. Med. Chem. 40: 2876-82; King et al. (1991), Exp. Hematol. 19: 481; King et al. (1995), Blood 86 (Suppl. 1): 309a |
| linear | IL-1 receptor | inflammatory and autoimmune diseases ("IL-1 antagonist" or "IL-1ra-mimetic") | U.S. Pat. No. 5,608,035; U.S. Pat. No. 5,786,331; U.S. Pat. No. 5,880,096; Yanofsky et al. (1996), Proc. Natl. Acad. Sci. 93: 7381-6; Akeson et al. (1996), J. Biol. Chem. 271: 30517-23; Wiekzorek et al. (1997), Pol. J. Pharmacol. 49: 107-17; Yanofsky (1996), PNAs, 93: 7381-7386. |
| linear | Facteur thymique serique (FTS) | stimulation of lymphocytes ("FTS-mimetic") | Inagaki-Ohara et al. (1996), Cellular Immunol. 171: 30-40; Yoshida (1984), Int. J. Immunopharmacol, 6: 141-6. |
| intrapeptide disulfide bonded | CTLA4 MAb | CTLA4-mimetic | Fukumoto et al. (1998), Nature Biotech. 16: 267-70 |
| exocyclic | TNF-α receptor | TNF-α antagonist | Takasaki et al. (1997), Nature Biotech. 15: 1266-70; WO 98/53842, published Dec. 3, 1998 |
| linear | TNF-α receptor | TNF-α antagonist | Chirinos-Rojas (1998), J. Imm., 5621-5626. |
| intrapeptide disulfide bonded | C3b | inhibition of complement activation; autoimmune diseases ("C3b-antagonist") | Sahu et al. (1996), J. Immunol. 157: 884-91; Morikis et al. (1998), Protein Sci. 7: 619-27 |
| linear | vinculin | cell adhesion processes-cell growth, differentiation, wound healing, tumor metastasis ("vinculin binding") | Adey et al. (1997), Biochem. J. 324: 523-8 |

TABLE 2-continued

Pharmacologically active peptides

| Form of peptide | Binding partner/ protein of interest[1] | Pharmacologic activity | Reference |
|---|---|---|---|
| linear | C4 binding protein (C4BP) | anti-thrombotic | Linse et al. (1997), J. Biol. Chem. 272: 14658-65 |
| linear | urokinase receptor | processes associated with urokinase interaction with its receptor (e.g., angiogenesis, tumor cell invasion and metastasis); ("UKR antagonist") | Goodson et al. (1994), Proc. Natl. Acad. Sci. 91: 7129-33; International application WO 97/35969, published Oct. 2, 1997 |
| linear | Mdm2, Hdm2 | Inhibition of inactivation of p53 mediated by Mdm2 or hdm2; anti-tumor ("Mdm/hdm antagonist") | Picksley et al. (1994), Oncogene 9: 2523-9; Bottger et al. (1997) J. Mol. Biol. 269: 744-56; Bottger et al. (1996), Oncogene 13: 2141-7 |
| linear | $p21^{WAF1}$ | anti-tumor by mimicking the activity of $p21^{WAF1}$ | Ball et al. (1997), Curr. Biol. 7: 71-80 |
| linear | farnesyl transferase | anti-cancer by preventing activation of ras oncogene | Gibbs et al. (1994), Cell 77: 175-178 |
| linear | Ras effector domain | anti-cancer by inhibiting biological function of the ras oncogene | Moodie et al. (1994), Trends Genet 10: 44-48 Rodriguez et al. (1994), Nature 370: 527-532 |
| linear | SH2/SH3 domains | anti-cancer by inhibiting tumor growth with activated tyrosine kinases; treatment of SH3-mediated disease states ("SH3 antagonist") | Pawson et al (1993), Curr. Biol. 3: 434-432 Yu et al. (1994), Cell 76: 933-945; Rickles et al. (1994), EMBO J. 13: 5598-5604; Sparks et al. (1994), J. Biol. Chem. 269: 23853-6; Sparks et al. (1996), Proc. Natl. Acad. Sci. 93: 1540-4; U.S. Pat. No. 5,886,150, issued Mar. 23, 1999; U.S. Pat. No. 5,888,763, issued Mar. 30, 1999 |
| linear | $p16^{INK4}$ | anti-cancer by mimicking activity of p16; e.g., inhibiting cyclin D-Cdk complex ("p16-mimetic") | Fåhraeus et al. (1996), Curr. Biol. 6: 84-91 |
| linear | Src, Lyn | inhibition of Mast cell activation, IgE-related conditions, type I hypersensitivity ("Mast cell antagonist") | Stauffer et al. (1997), Biochem. 36: 9388-94 |
| linear | Mast cell protease | treatment of inflammatory disorders mediated by release of tryptase-6 ("Mast cell protease inhibitors") | International application WO 98/33812, published Aug. 6, 1998 |
| linear | HBV core antigen (HBcAg) | treatment of HBV viral infections ("anti-HBV") | Dyson & Muray (1995), Proc. Natl. Acad. Sci. 92: 2194-8 |
| linear | selectins | neutrophil adhesion; inflammatory diseases ("selectin antagonist") | Martens et al. (1995), J. Biol. Chem. 270: 21129-36; European patent application EP 0 714 912, published Jun. 5, 1996 |
| linear, cyclized | calmodulin | calmodulin antagonist | Pierce et al. (1995), Molec. Diversity 1: 259-65; Dedman et al. (1993), J. Biol. Chem. 268: 23025-30; Adey & Kay (1996), Gene 169: 133-4 |

TABLE 2-continued

Pharmacologically active peptides

| Form of peptide | Binding partner/ protein of interest[1] | Pharmacologic activity | Reference |
|---|---|---|---|
| linear, cyclized- | integrins | tumor-homing; treatment for conditions related to integrin-mediated cellular events, including platelet aggregation, thrombosis, wound healing, osteoporosis, tissue repair, angiogenesis (e.g., for treatment of cancer), and tumor invasion ("integrin-binding") | International applications WO 95/14714, published Jun. 1, 1995; WO 97/08203, published Mar. 6, 1997; WO 98/10795, published Mar. 19, 1998; WO 99/24462, published May 20, 1999; Kraft et al. (1999), J. Biol. Chem. 274: 1979-1985 |
| cyclic, linear | fibronectin and extracellular matrix components of T cells and macrophages | treatment of inflammatory and autoimmune conditions | WO 98/09985, published Mar. 12, 1998 |
| linear | somatostatin and cortistatin | treatment or prevention of hormone-producing tumors, acromegaly, giantism, dementia, gastric ulcer, tumor growth, inhibition of hormone secretion, modulation of sleep or neural activity | European patent application 0 911 393, published Apr. 28, 1999 |
| linear | bacterial lipopolysaccharide | antibiotic; septic shock; disorders modulatable by CAP37 | U.S. Pat. No. 5,877,151, issued Mar. 2, 1999 |
| linear or cyclic, including D-amino acids | pardaxin, mellitin | antipathogenic | WO 97/31019, published 28 Aug. 1997 |
| linear, cyclic | VIP | impotence, neurodegenerative disorders | WO 97/40070, published Oct. 30, 1997 |
| linear | CTLs | cancer | EP 0 770 624, published May 2, 1997 |
| linear | THF-gamma2 | | Burnstein (1988), Biochem., 27: 4066-71. |
| linear | Amylin | | Cooper (1987), Proc. Natl. Acad. Sci., 84: 8628-32. |
| linear | Adrenomedullin | | Kitamura (1993), BBRC, 192: 553-60. |
| cyclic, linear | VEGF | anti-angiogenic; cancer, rheumatoid arthritis, diabetic retinopathy, psoriasis ("VEGF antagonist") | Fairbrother (1998), Biochem., 37: 17754-17764. |
| cyclic | MMP | inflammation and autoimmune disorders; tumor growth ("MMP inhibitor") | Koivunen (1999), Nature Biotech., 17: 768-774. |
| | HGH fragment | treatment of obesity | U.S. Pat. No. 5,869,452 |
| | Echistatin | inhibition of platelet aggregation | Gan (1988), J. Biol. Chem., 263: 19827-32. |
| linear | SLE autoantibody | SLE | WO 96/30057, published Oct. 3, 1996 |
| | GD1alpha | suppression of tumor metastasis | Ishikawa et al. (1998), FEBS Lett. 441 (1): 20-4 |
| | antiphospholipid beta-2-glycoprotein-I ($\beta$2GPI) antibodies | endothelial cell activation, antiphospholipid syndrome (APS), thromboembolic phenomena, thrombocytopenia, and recurrent fetal loss | Blank et al. (1999), Proc. Natl. Acad. Sci. USA 96: 5164-8 |
| linear | T Cell Receptor beta chain | diabetes | WO 96/11214, published Apr. 18, 1996. |
| | | Antiproliferative, antiviral | WO 00/01402, published Jan. 13, 2000. |
| | | anti-ischemic, growth hormone-liberating | WO 99/62539, published Dec. 9, 1999. |
| | | anti-angiogenic | WO 99/61476, published Dec. 2, 1999. |

TABLE 2-continued

Pharmacologically active peptides

| Form of peptide | Binding partner/ protein of interest[1] | Pharmacologic activity | Reference |
|---|---|---|---|
| linear | | Apoptosis agonist; treatment of T cell-associated disorders (e.g., autoimmune diseases, viral infection, T cell leukemia, T cell lymphoma) | WO 99/38526, published Aug. 5, 1999. |
| linear | MHC class II | treatment of autoimmune diseases | U.S. Pat. No. 5,880,103, issued Mar. 9, 1999. |
| linear | androgen R, p75, MJD, DCC, huntingtin | proapoptotic, useful in treating cancer | WO 99/45944, published Sep. 16, 1999. |
| linear | von Willebrand Factor; Factor VIII | inhibition of Factor VIII interaction; anticoagulants | WO 97/41220, published Apr. 29, 1997. |
| linear | lentivirus LLP1 | antimicrobial | U.S. Pat. No. 5,945,507, issued Aug. 31, 1999. |
| linear | Delta-Sleep Inducing Peptide | sleep disorders | Graf (1986), Peptides 7: 1165. |
| linear | C-Reactive Protein (CRP) | inflammation and cancer | Barna (1994), Cancer Immunol. Immunother. 38: 38 (1994). |
| linear | Sperm-Activating Peptides | infertility | Suzuki (1992), Comp. Biochem. Physiol. 102B: 679. |
| linear | angiotensins | hematopoietic factors for hematocytopenic conditions from cancer, AIDS, etc. | Lundergan (1999), J. Periodontal Res. 34(4): 223-228. |
| linear | HIV-1 gp41 | anti-AIDS | Chan (1998), Cell 93: 681-684. |
| linear | PKC | inhibition of bone resorption | Moonga (1998), Exp. Physiol. 83: 717-725. |
| linear | defensins (HNP-1, -2, -3, -4) | antimicrobial | Harvig (1994), Methods Enz. 236: 160-172. |
| linear | p185$^{HER2/neu}$, C-erbB-2 | AHNP-mimetic: anti-tumor | Park (2000), Nat. Biotechnol. 18: 194-198. |
| linear | gp130 | IL-6 antagonist | WO 99/60013, published Nov. 25, 1999. |
| linear | collagen, other joint, cartilage, arthritis-related proteins | autoimmune diseases | WO 99/50282, published Oct. 7, 1999. |
| linear | HIV-1 envelope protein | treatment of neurological degenerative diseases | WO 99/51254, published Oct. 14, 1999. |
| linear | IL-2 | autoimmune disorders (e.g., graft rejection, rheumatoid arthritis) | WO 00/04048, published Jan. 27, 2000; WO 00/11028, published Mar. 2, 2000. |

[1]The protein listed in this column may be bound by the associated peptide (e.g., EPO receptor, IL-1 receptor) or mimicked by the associated peptide. The references listed for each clarify whether the molecule is bound by or mimicked by the peptides.

Peptides identified by peptide library screening have been regarded as "leads" in development of therapeutic agents rather than being used as therapeutic agents themselves. Like other proteins and peptides, they would be rapidly removed in vivo either by renal filtration, cellular clearance mechanisms in the reticuloendothelial system, or proteolytic degradation. (Francis (1992), Focus on Growth Factors 3: 4-11.) As a result, the art presently uses the identified peptides to validate drug targets or as scaffolds for design of organic compounds that might not have been as easily or as quickly identified through chemical library screening. Lowman (1997), Ann. Rev. Biophys. Biomol. Struct. 26: 401-24; Kay et al. (1998), Drug Disc. Today 3: 370-8.

Typically, purified peptides are only marginally stable in an aqueous state and undergo chemical and physical degradation resulting in a loss of biological activity during processing and storage. Additionally, peptide compositions in aqueous solution undergo hydrolysis, such as deamidation and peptide bond cleavage. These effects represent a serious problem for therapeutically active peptides which are intended to be administered to humans within a defined dosage range based on biological activity.

Administration of purified peptides remains a promising treatment strategy for many diseases that affect the human population. However, the ability of the therapeutic peptibody to remain a stable pharmaceutical composition over time in a variety of storage conditions and then be effective for patients in vivo has not been addressed. Thus, there remains a need in the art to provide therapeutic peptibodies in stable formulations that are useful as therapeutic agents for the treatment of diseases and disorders.

SUMMARY OF THE INVENTION

The present invention provides formulations useful for lyophilization of therapeutic peptibodies, resulting in a highly stable therapeutic peptibody product. The stable therapeutic peptibody product is useful as a therapeutic agent in the treatment of individuals suffering from disorders or conditions that can benefit from the administration of the therapeutic peptibody.

In one aspect, the invention provides a lyophilized therapeutic peptibody composition comprising a buffer, a bulking agent, a stabilizing agent, and optionally a surfactant; wherein the buffer is comprised of a pH buffering agent in a range of about 5 mM to about 20 mM and wherein the pH is in a range of about 3.0 to about 8.0; wherein the bulking agent is at a concentration of about 0% to about 4.5% w/v; wherein the stabilizing agent is at a concentration of about 0.1% to about 20% w/v; wherein the surfactant is at a concentration of about 0.004% to about 0.4% w/v; and wherein the therapeutic peptibody comprises a structure set out in Formula I, $$[(X^1)_a—F^1—(X^2)_b]-(L^1)_c-WSP_d \quad \text{Formula I}$$

wherein:
$F^1$ is an Fc domain;
$X^1$ is selected from
$P^1-(L^2)_e-$
$P^2-(L^3)_f-P^1-(L^2)_e-$
$P^3-(L^4)_g-P^2-(L^3)_f-P^1-(L^2)_e-$ and
$P^4-(L^5)_h-P^3-(L^4)_g-P^2-(L^3)_f-P^1-(L^2)_e-$
$X^2$ is selected from:
$-(L^2)_e-P^1$,
$-(L^2)_e-P^1-(L^3)_f-P^2$,
$-(L^2)_e-P^1-(L^3)_f-P^2-(L^4)_g-P^3$, and
$-(L^2)_e-P^1-(L^3)_f-P^2-(L^4)_g-P^3-(L^5)_h-P^4$ wherein $P^1$, $P^2$, $P^3$, and $P^4$ are each independently sequences of pharmacologically active peptides;
$L^1$, $L^2$, $L^3$, $L^4$, and $L^5$ are each independently linkers;
a, b, c, e, f, g, and h are each independently 0 or 1;
provided that at least one of a and b is 1;
d is 0, 1, or greater than 1; and
WSP is a water soluble polymer, the attachment of which is effected at any reactive moiety in $F^1$.

In another embodiment, the therapeutic peptibody comprises a structure set out in Formula II $$[X^1—F^1]-(L^1)_c-WSP_d \quad \text{Formula II}$$

wherein the Fc domain is attached at the C-terminus of $X^1$, and zero, one or more WSP is attached to the Fc domain, optionally through linker $L^1$.

In still another embodiment, the therapeutic peptibody comprises a structure set out in Formula III $$[F^1—X^2]-(L^1)_c-WSP_d \quad \text{Formula III}$$

wherein the Fc domain is attached at the N-terminus of $X^2$, and zero, one or more WSP is attached to the Fc domain, optionally through linker $L^1$.

In yet another embodiment, the therapeutic peptibody comprises a structure set out in Formula IV $$[F^1-(L^1)_e-P^1]-(L^1)_c-WSP_d \quad \text{Formula IV}$$

wherein the Fc domain is attached at the N-terminus of $-(L^1)_c-P^1$ and zero, one or more WSP is attached to the Fc domain, optionally through linker $L^1$.

In another embodiment, the therapeutic peptibody comprises a structure set out in Formula V $$[F^1-(L^1)_e-P^1-(L^2)_f-P^2]-(L^1)_c-WSP_d \quad \text{Formula V}$$

wherein the Fc domain is attached at the N-terminus of $-L^1-P^1-L^2-P^2$ and zero, one or more WSP is attached to the Fc domain, optionally through linker $L^1$.

In another embodiment, the therapeutic peptibody is a multimer or dimer. In another embodiment, an aforementioned composition is provided wherein $P^1$, $P^2$, $P^3$ and/or $P^4$ are independently selected from a peptide set out in any one of Tables 4 through 38. In a related embodiment, $P^1$, $P^2$, $P^3$ and/or $P^4$ have the same amino acid sequence. In another embodiment, the Fc domain is set out in SEQ ID NO:1. In another embodiment, WSP is PEG. In still another embodiment, the Fc domain is et out in SEQ ID NO:1 and WSP is PEG. In another embodiment, the PEG has a molecular weight of between about 2 kDa and 100 kDa, or between 6 kDa and 25 kDa. In another embodiment, the composition comprises at least 50%, 75%, 85%, 90%, or 95% PEGylated therapeutic peptibody.

In yet another embodiment of the invention, an aforementioned composition is provided wherein the pH buffering agent is selected from the group consisting of glycine, histidine, glutamate, succinate, phosphate, acetate, and aspartate. In yet another embodiment of the invention, an aforementioned composition is provided wherein the bulking agent selected from the group consisting of mannitol, glycine, sucrose, dextran, polyvinylpyrolidone, carboxymethylcellulose, lactose, sorbitol, trehalose, or xylitol.

In yet another embodiment of the invention, an aforementioned composition is provided wherein the stabilizing agent selected from the group consisting of sucrose, trehalose, mannose, maltose, lactose, glucose, raffinose, cellobiose, gentiobiose, isomaltose, arabinose, glucosamine, fructose, mannitol, sorbitol, glycine, arginine HCL, poly-hydroxy compounds, including polysaccharides such as dextran, starch, hydroxyethyl starch, cyclodextrins, N-methylpyrollidene, cellulose and hyaluronic acid, sodium chloride.

In yet another embodiment of the invention, an aforementioned composition is provided wherein the surfactant selected from the group consisting of sodium lauryl sulfate, dioctyl sodium sulfosuccinate, dioctyl sodium sulfonate, chenodeoxycholic acid, N-lauroylsarcosine sodium salt, lithium dodecyl sulfate, 1-octanesulfonic acid sodium salt, sodium cholate hydrate, sodium deoxycholate, glycodeoxycholic acid sodium salt, benzalkonium chloride or benzethonium chloride, cetylpyridinium chloride monohydrate, hexadecyltrimethylammonium bromide, CHAPS, CHAPSO, SB3-10, SB3-12, digitonin, Triton X-100, Triton X-114, lauromacrogol 400, polyoxyl 40 stearate, polyoxyethylene hydrogenated castor oil 10, 40, 50 and 60, glycerol monostearate, polysorbate 20, 40, 60, 65 and 80, soy lecithin, DOPC, DMPG, DMPC, and DOPG; sucrose fatty acid ester, methyl cellulose and carboxymethyl cellulose. In yet another embodiment of the invention, an aforementioned composition is provided wherein the therapeutic peptibody concentration is between about 0.25 mg/mL and 250 mg/mL.

In another embodiment of the invention, an aforementioned composition is provided wherein the pH buffering agent is 10 mM histidine and wherein the pH is 5.0; wherein the bulking agent is 4% w/v mannitol; wherein the stabilizing agent is 2% w/v sucrose; and wherein the surfactant is 0.004% w/v polysorbate-20. In another embodiment, the aforementioned composition is provided wherein $P^1$ comprises a sequence set forth in Table 6. In yet another embodiment of the invention, an aforementioned composition is provided wherein the therapeutic peptibody concentration is 0.5 mg/mL. In another embodiment, the therapeutic peptibody is any one of SEQ ID NO:993, SEQ ID NO:994, SEQ ID NO:995, SEQ ID NO:996, SEQ ID NO:997, SEQ ID NO:998, SEQ ID NO:999, SEQ ID NO:1000, SEQ ID NO:1001, SEQ ID NO:1002, SEQ ID NO:1003, SEQ ID NO:1004, SEQ ID NO:1005, SEQ ID NO:1006, SEQ ID NO:1007, SEQ ID NO:1008, SEQ ID NO:1009, SEQ ID NO:1010, SEQ ID NO:1011, SEQ ID NO:1012, SEQ ID NO:1013, SEQ ID NO:1014, SEQ ID NO:1015, SEQ ID NO:1016, or SEQ ID NO:1017.

In yet another embodiment of the invention, an aforementioned composition is provided wherein the pH buffering agent is 10 mM histidine and wherein the pH is 7.0; wherein the bulking agent is 4% w/v mannitol; wherein the stabilizing agent is 2% w/v sucrose; and wherein the surfactant is 0.01% w/v polysorbate-20. In another embodiment, the aforementioned composition is provided wherein $P^1$ comprises a sequence set forth in Table 32. In yet another embodiment of the invention, an aforementioned composition is provided wherein the therapeutic peptibody concentration is 30 mg/mL.

In still another embodiment of the invention, an aforementioned composition is provided wherein the pH buffering agent is 20 mM histidine and wherein the pH is 5.0; wherein the bulking agent is 3.3% w/v mannitol; wherein the stabilizing agent is 2% w/v sucrose; and wherein the surfactant is 0.01% w/v polysorbate-20. In another embodiment, the aforementioned composition is provided wherein $P^1$ comprises a sequence set forth in Table 4. In yet another embodiment of the invention, an aforementioned composition is provided wherein the therapeutic peptibody concentration is 100 mg/mL.

In still another embodiment of the invention, an aforementioned composition is provided wherein the pH buffering agent is 10 mM histidine and wherein the pH is 5.0; wherein the bulking agent is 2.5% w/v mannitol; and wherein the stabilizing agent is 3.5% w/v sucrose. In another embodiment, the aforementioned composition is provided wherein $P^1$ comprises a sequence set forth in Table 31. In yet another embodiment of the invention, an aforementioned composition is provided wherein the therapeutic peptibody concentration is 30 mg/mL.

In another embodiment of the invention, an aforementioned composition is provided wherein the composition is selected from the group consisting of: a) 10 mM histidine, pH 4.7, 4% mannitol and 2% sucrose, with and without 0.004% polysorbate-20; b) 10 mM histidine, pH 5, 4% mannitol and 2% sucrose, with and without 0.004% polysorbate-20; c) 10 mM glutamate, pH 4.5, 4% mannitol and 2% sucrose with and without 0.004% polysorbate-20; d) 10 mM succinate, pH 4.5, 4% mannitol and 2% sucrose, 0.004% polysorbate-20; e) 10 mM glutamate, pH 4.5, 9% sucrose, 0.004% polysorbate-20; f) 10 mM glutamate, pH 4.5, 4% mannitol, 2% sucrose, 1% hydroxyethyl starch, 0.004% polysorbate-20; g) 5 mM glutamate, pH 4.5, 2% mannitol, 1% sucrose, 0.004% polysorbate-20; and h) 10 mM glutamate, pH 4.5, 4% mannitol, 2% trehalose, 0.004% polysorbate-20. In another embodiment, the aforementioned composition is provided wherein $P^1$ comprises a sequence set forth in Tables 21-24. In still another embodiment, the aforementioned composition is provided wherein the therapeutic peptibody concentration is selected from the group consisting of 1, 30, 85, and 100 mg/mL.

The present invention also contemplates methods of making lyophilized therapeutic peptibodies of the present invention. In one embodiment, the invention provides a method for making a lyophilized therapeutic peptibody comprising the steps of: a) preparing a solution of a buffer, a bulking agent, a stabilizing agent, and a optionally surfactant; wherein the buffer is comprised of a pH buffering agent in a range of about 5 mM to about 20 mM and wherein the pH is in a range of about 3.0 to about 8.0; wherein the bulking agent is at a concentration of about 2.5% to about 4% w/v; wherein the stabilizing agent is at a concentration of about 0.1% to about 5% w/v; wherein the surfactant is at a concentration of about 0.004% to about 0.04% w/v; and b) lyophilizing the therapeutic peptibody; wherein the therapeutic peptibody comprises a structure set out in Formula I,

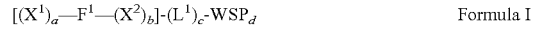
$$[(X^1)_a\text{---}F^1\text{---}(X^2)_b]\text{-}(L^1)_c\text{-}WSP_d \qquad \text{Formula I}$$

wherein:
$F^1$ is an Fc domain;
$X^1$ is selected from
$P^1\text{-}(L^2)_e\text{-}$
$P^2\text{-}(L^3)_f\text{-}P^1\text{-}(L^2)_e\text{-}$
$P^3\text{-}(L^4)_g\text{-}P^2\text{-}(L^3)_f\text{-}P^1\text{-}(L^2)_e\text{-}$ and
$P^4\text{-}(L^5)_h\text{-}P^3\text{-}(L^4)_g\text{-}P^2\text{-}(L^3)_f\text{-}P^1\text{-}(L^2)_e$
$X^2$ is selected from:
$\text{-}(L^2)_e\text{-}P^1$,
$\text{-}(L^2)_e\text{-}P^1\text{-}(L^1)_f\text{-}P^2$,
$\text{-}(L^2)_e\text{-}P^1\text{-}(L^3)_f\text{-}P^2\text{-}(L^4)_g\text{-}P^3$, and
$\text{-}(L^2)_e\text{-}P^1\text{-}(L^3)_f\text{-}P^2\text{-}(L^4)_g\text{-}P^3\text{-}(L^5)_h\text{-}P^4$ wherein $P^1$, $P^2$, $P^3$, and $P^4$ are each independently sequences of pharmacologically active peptides;
$L^1$, $L^2$, $L^3$, $L^4$, and $L^5$ are each independently linkers;
a, b, c, e, f, g, and h are each independently 0 or 1,
provided that at least one of a and b is 1;
d is 0, 1, or greater than 1; and
WSP is a water soluble polymer, the attachment of which is effected at any reactive moiety in $F^1$.

In another embodiment, the aforementioned method is provided wherein the therapeutic peptibody comprises a structure set out in Formula II

$$[X^1\text{---}F^1]\text{-}(L^1)_c\text{-}WSP_d \qquad \text{Formula II}$$

wherein the Fc domain is attached at the C-terminus of $X^1$, and zero, one or more WSP is attached to the Fc domain, optionally through linker $L^1$.

In another embodiment, the aforementioned method is provided wherein the therapeutic peptibody comprises a structure set out in Formula III

$$[F^1\text{---}X^2]\text{-}(L^1)_c\text{-}WSP_d \qquad \text{Formula III}$$

wherein the Fc domain is attached at the N-terminus of $X^2$, and zero, one or more WSP is attached to the Fc domain, optionally through linker $L^1$.

In another embodiment, the aforementioned method is provided wherein the therapeutic peptibody comprises a structure set out in Formula IV

$$[F^1\text{-}(L^1)_e\text{-}P^1]\text{-}(L^1)_c\text{-}WSP_d \qquad \text{Formula IV}$$

wherein the Fc domain is attached at the N-terminus of $\text{-}(L^1)_e\text{-}P^1$ and zero, one or more WSP is attached to the Fc domain, optionally through linker $L^1$.

In another embodiment, the aforementioned method is provided wherein the therapeutic peptibody comprises a structure set out in Formula V

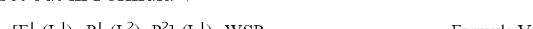
$$[F^1\text{-}(L^1)_e\text{-}P^1\text{-}(L^2)_f\text{-}P^2]\text{-}(L^1)_c\text{-}WSP_d \qquad \text{Formula V}$$

wherein the Fc domain is attached at the N-terminus of $\text{-}L^1\text{-}P^1\text{-}L^2\text{-}P^2$ and zero, one or more WSP is attached to the Fc domain, optionally through linker $L^1$.

In another embodiment, the aforementioned method is provided wherein the therapeutic peptibody is a multimer or dimer. In another embodiment, the $P^1$, $P^2$, $P^3$ and/or $P^4$ are independently selected from a peptide set out in any one of Tables 4 through 38. In another embodiment, the $P^1$, $P^2$, $P^3$ and/or $P^4$ have the same amino acid sequence. In another embodiment, the Fc domain is set out in SEQ ID NO:1. In another embodiment, WSP is PEG. In another embodiment, the Fc domain is set out in SEQ ID NO:1 and WSP is PEG. In another embodiment, PEG has a molecular weight of between about 2 kDa and 100 kDa or between about 6 kDa and 25 kDa. In another embodiment, the aforementioned method is provided wherein the composition comprises at least 50%, 75%, 85%, 90%, or 95% PEGylated therapeutic peptibody.

In another embodiment, the aforementioned method is provided wherein the pH buffering agent is selected from the group consisting of glycine, histidine, glutamate, succinate, phosphate, acetate, and aspartate. In another embodiment, the aforementioned method is provided wherein the bulking agent selected from the group consisting of mannitol, glycine, sucrose, dextran, polyvinylpyrolidone, carboxymethylcellulose, lactose, sorbitol, trehalose, or xylitol. In another embodiment, the aforementioned method is provided wherein the stabilizing agent selected from the group consisting of sucrose, trehalose, mannose, maltose, lactose, glucose, raffinose, cellobiose, gentiobiose, isomaltose, arabinose, glucosamine, fructose, mannitol, sorbitol, glycine, arginine HCL, poly-hydroxy compounds, including polysaccharides such as dextran, starch, hydroxyethyl starch, cyclodextrins, N-methylpyrollidene, cellulose and hyaluronic acid, sodium chloride.

In another embodiment, the aforementioned method is provided wherein the surfactant selected from the group consisting of sodium lauryl sulfate, dioctyl sodium sulfosuccinate, dioctyl sodium sulfonate, chenodeoxycholic acid, N-lauroylsarcosine sodium salt, lithium dodecyl sulfate, 1-octanesulfonic acid sodium salt, sodium cholate hydrate, sodium deoxycholate, glycodeoxycholic acid sodium salt, benzalkonium chloride or benzethonium chloride, cetylpyridinium chloride monohydrate, hexadecyltrimethylammonium bromide, CHAPS, CHAPSO, SB3-10, SB3-12, digitonin, Triton X-100, Triton X-114, lauromacrogol 400, polyoxyl 40 stearate, polyoxyethylene hydrogenated castor oil 10, 40, 50 and 60, glycerol monostearate, polysorbate 20, 40, 60, 65 and 80, soy lecithin, DOPC, DMPG, DMPC, and DOPG; sucrose fatty acid ester, methyl cellulose and carboxymethyl cellulose. In another embodiment, the aforementioned method is provided wherein the therapeutic peptibody concentration is between about 0.25 mg/mL and 250 mg/mL.

In another embodiment, an aforementioned method is provided wherein the pH buffering agent is 10 mM histidine and wherein the pH is 5.0; wherein the bulking agent is 4% w/v mannitol; wherein the stabilizing agent is 2% w/v sucrose; and wherein the surfactant is 0.004% w/v polysorbate-20. In another embodiment, the aforementioned method is provided wherein $P^1$ comprises a sequence set forth in Table 6. In another embodiment, the aforementioned method is provided wherein the therapeutic peptibody concentration is 0.5 mg/mL.

In another embodiment, an aforementioned method is provided wherein the pH buffering agent is 10 mM histidine and wherein the pH is 7.0; wherein the bulking agent is 4% w/v mannitol; wherein the stabilizing agent is 2% w/v sucrose; and wherein the surfactant is 0.01% w/v polysorbate-20. In another embodiment, the aforementioned method is provided wherein $P^1$ comprises a sequence set forth in Table 32. In another embodiment, the aforementioned method is provided wherein the therapeutic peptibody concentration is 30 mg/mL.

In another embodiment, an aforementioned method is provided wherein the pH buffering agent is 20 mM histidine and wherein the pH is 5.0; wherein the bulking agent is 3.3% w/v mannitol; wherein the stabilizing agent is 2% w/v sucrose; and wherein the surfactant is 0.01% w/v polysorbate-20. In another embodiment, the aforementioned method is provided wherein $P^1$ comprises a sequence set forth in Table 4. In another embodiment, the aforementioned method is provided wherein the therapeutic peptibody concentration is 100 mg/mL.

In another embodiment, an aforementioned method is provided wherein the pH buffering agent is 10 mM histidine and wherein the pH is 5.0; wherein the bulking agent is 2.5% w/v mannitol; and wherein the stabilizing agent is 3.5% w/v sucrose. In another embodiment, the aforementioned method is provided wherein $P^1$ comprises a sequence set forth in Table 31. In another embodiment, the aforementioned method is provided wherein the therapeutic peptibody concentration is 30 mg/mL.

In another embodiment of the invention, an aforementioned method is provided wherein the composition is selected from the group consisting of: a) 10 mM histidine, pH 4.7, 4% mannitol and 2% sucrose, with and without 0.004% polysorbate-20; b) 10 mM histidine, pH 5, 4% mannitol and 2% sucrose, with and without 0.004% polysorbate-20; c) 10 mM glutamate, pH 4.5, 4% mannitol and 2% sucrose with and without 0.004% polysorbate-20; d) 10 mM succinate, pH 4.5, 4% mannitol and 2% sucrose, 0.004% polysorbate-20; e) 10 mM glutamate, pH 4.5, 9% sucrose, 0.004% polysorbate-20; f) 10 mM glutamate, pH 4.5, 4% mannitol, 2% sucrose, 1% hydroxyethyl starch, 0.004% polysorbate-20; g) 5 mM glutamate, pH 4.5, 2% mannitol, 1% sucrose, 0.004% polysorbate-20; and h) 10 mM glutamate, pH 4.5, 4% mannitol, 2% trehalose, 0.004% polysorbate-20. In another embodiment, the aforementioned method is provided wherein $P^1$ comprises a sequence set forth in Tables 21-24. In still another embodiment, the aforementioned method is provided wherein the therapeutic peptibody concentration is selected from the group consisting of 1, 30, 85, and 100 mg/mL.

In another embodiment, an aforementioned method is provided further comprising, prior to lyophilization, the steps of: b) adjusting the pH of the solution to a pH between about 4.0 and about 8.0; c) preparing a solution containing the therapeutic peptibody; d) buffer exchanging the solution of step (c) into the solution of step (b); e) adding an appropriate amount of a surfactant; and f) lyophilizing the mixture from step (e).

In another embodiment, the aforementioned method is provided wherein a method for preparing a reconstituted therapeutic peptibody composition is provided comprising the steps of: a) lyophilizing an aforementioned therapeutic peptibody composition; and b) reconstituting the lyophilized therapeutic peptibody composition.

In another embodiment, a kit for preparing an aqueous pharmaceutical composition is provided comprising a first container having an aforementioned lyophilized therapeutic peptibody composition, and a second container having a physiologically acceptable solvent for the lyophilized composition.

DETAILED DESCRIPTION OF THE INVENTION

Definition of Terms

The term "comprising," with respect to a peptide compound, means that a compound may include additional amino acids on either or both of the amino or carboxy termini of the given sequence. Of course, these additional amino acids should not significantly interfere with the activity of the compound. With respect to a composition of the instant invention, the term "comprising" means that a composition may include additional components. These additional components should not significantly interfere with the activity of the composition.

The term "peptibody" refers to a molecule comprising peptide(s) fused either directly or indirectly to other molecules such as an Fc domain of an antibody, where the peptide moiety specifically binds to a desired target. The peptide(s) may be fused to either an Fc region or inserted into an Fc-Loop, a modified Fc molecule. Fc-Loops are described in U.S. Patent Application Publication No. US2006/0140934 incorporated herein by reference in its entirety. The invention includes such molecules comprising an Fc domain modified to comprise a peptide as an internal sequence (preferably in a loop region) of the Fc domain. The Fc internal peptide molecules may include more than one peptide sequence in tandem in a particular internal region, and they may include further peptides in other internal regions. While the putative loop regions are exemplified, insertions in any other non-terminal domains of the Fc are also considered part of this invention. The term "peptibody" does not include Fc-fusion proteins (e.g., full length proteins fused to an Fc domain).

The term "vehicle" refers to a molecule that prevents degradation and/or increases half-life, reduces toxicity, reduces immunogenicity, or increases biological activity of a therapeutic protein. Exemplary vehicles include an Fc domain as described in U.S. Pat. No. 5,428,130 to Capon et al., issued Jun. 27, 1995.

The term "native Fc" refers to molecule or sequence comprising the sequence of a non-antigen-binding fragment resulting from digestion of whole antibody, whether in monomeric or multimeric form. Typically, a native Fc comprises a CH2 and CH3 domain. The original immunoglobulin source of the native Fc is in one aspect of human origin and may be any of the immunoglobulins. A native Fc is a monomeric polypeptide that may be linked into dimeric or multimeric forms by covalent association (i.e., disulficle bonds), non-covalent association or a combination of both. The number of intermolecular disulfide bonds between monomeric subunits of native Fc molecules ranges from one to four depending on class (e.g., IgG, IgA, IgE) or subclass (e.g., IgG1, IgG2, IgG3, IgA1, IgGA2). One example of a native Fc is a disulfide-bonded dimer resulting from papain digestion of an IgG. Ellison et al. (1982), Nucleic Acids Res. 10: 4071-9. The term "native Fc" as used herein is generic to the monomeric, dimeric, and multimeric forms.

The term "Fc variant" refers to a molecule or sequence that is modified from a native Fc, but still comprises a binding site for the salvage receptor, FcRn. International applications WO 97/34631 (published 25 Sep. 1997) and WO 96/32478 describe exemplary Fc variants, as well as interaction with the salvage receptor, and are hereby incorporated by reference. In one aspect, the term "Fc variant" comprises a molecule or sequence that is humanized from a non-human native Fc. In another aspect, a native Fc comprises sites that may be removed because they provide structural features or biological activity that are not required for the fusion molecules of the present invention. Thus, the term "Fc variant" comprises a molecule or sequence that lacks one or more native Fc sites or residues that affect or are involved in (1) disulfide bond formation, (2) incompatibility with a selected host cell (3) N-terminal heterogeneity upon expression in a selected host cell, (4) glycosylation, (5) interaction with complement, (6) binding to an Fc receptor other than a salvage receptor, or (7) antibody-dependent cellular cytotoxicity (ADCC). Fc variants are described in further detail hereinafter.

The term "Fc domain" encompasses native Fc and Fc variant molecules and sequences as defined above. As with Fc variants and native Fcs, the term "Fc domain" includes molecules in monomeric or multimeric form, whether digested from whole antibody or produced by other means. In one embodiment, for example, the Fc region can be:

(SEQ ID NO: 1)
DKTHTCPPCPAPELLGGPSVFLFPPKPKDTLMISRTPEVTCVVVDVSHED

PEVKFNWYVDGVEVHNAKTKPREEQYNSTYRVVSVLTVLHQDWLNGKEYK

CKVSNKALPAPIEKTISKAKGQPREPQVYTLPPSRDELTKNQVSLTCLVK

GFYPSDIAVEWESNGQPENNYKTTPPVLDSDGSFFLYSKLTVDKSRWQQG

NVFSCSVMHEALHNHYTQKSLSLSPGK.

Additional Fc sequences are known in the art and are contemplated for use in the invention. For example, Fc IgG1 (GenBank Accession No. P01857), Fc IgG2 (GenBank Accession No. P01859), Fc IgG3 (GenBank Accession No. P01860), Fc IgG4 (GenBank Accession No. P01861), Fc IgA1 (GenBank Accession No. P01876), Fc IgA2 (GenBank Accession No. P01877), Fc IgD (GenBank Accession No. P01880), Fc IgM (GenBank Accession No. P01871), and Fc IgE (GenBank Accession No. P01854) are some additional Fc sequences contemplated for use herein.

Optionally, an N-terminal amino acid sequence may be added to the above sequences (e.g., where expressed in bacteria).

The term "multimer" as applied to Fc domains or molecules comprising Fc domains refers to molecules having two or more polypeptide chains associated covalently, noncovalently, or by both covalent and non-covalent interactions. IgG molecules typically form dimers; IgM, pentamers; IgD, dimers; and IgA, monomers, dimers, trimers, or tetramers. Multimers may be formed by exploiting the sequence and resulting activity of the native Ig source of the Fc or by derivatizing (as defined below) such a native Fc.

The terms "derivatizing," "derivative" or "derivatized" mean processes and resulting compounds in which, for example and without limitation, (1) the compound has a cyclic portion; for example, cross-linking between cysteinyl residues within the compound; (2) the compound is cross-linked or has a cross-linking site; for example, the compound has a cysteinyl residue and thus forms cross-linked dimers in culture or in vivo; (3) one or more peptidyl linkage is replaced by a non-peptidyl linkage; (4) the N-terminus is replaced by —NRR$_1$, NRC(O)R$_1$, —NRC(O)OR$_1$, —NRS(O)$_2$R$_1$, —NHC(O)NHR, a succinimide group, or substituted or unsubstituted benzyloxycarbonyl-NH—, wherein R and R$_1$ and the ring substituents are as defined hereinafter; (5) the C-terminus is replaced by —C(O)R$_2$ or —NR$_3$R$_4$ wherein R$_2$, R$_3$ and R$_4$ are as defined hereinafter; and (6) compounds in which individual amino acid moieties are modified through treatment with agents capable of reacting with selected side chains or terminal residues. Derivatives are further described hereinafter.

As used herein the term "peptide" refers to molecules of 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 87, 88, 89, 90, 91, 92, 93, 94, 95, 96, 97, 98, 99, 100 or more amino acids linked by peptide bonds. Peptides typically contain random and/or flexible conformations, such as random coils; and typically lack stable conformations, such as those observed in larger proteins/polypeptides, typically via secondary and tertiary structures. In particular embodiments, numerous size ranges of peptides are contemplated herein, such from about: 3-90, 3-80, 3-70, 3-60, 3-50; 5-90, 5-80, 5-70, 5-60, 5-50, 5-40, 5-30; 10-90, 10-80, 10-70, 10-60, 10-50, 10-40, 10-30; 10-20 amino acids in length, and the like. In further embodiments, the peptides used herein are no more than 100, 90, 80, 70, 60, 50, 40, 30, or 20 amino acids in length. Exemplary peptides may be generated by any of the methods set forth herein, such as carried in a peptide library (e.g., a phage display library), generated by chemical synthesis, derived by digestion of proteins, or generated using recombinant DNA techniques. Peptides include D and L form, either purified or in a mixture of the two forms.

Additionally, physiologically acceptable salts of the compounds of this invention are also contemplated. By "physiologically acceptable salts" is meant any salts that are known or later discovered to be pharmaceutically acceptable. Some specific examples are: acetate; trifluoroacetate; hydrohalides, such as hydrochloride and hydrobromide; sulfate; citrate; tartrate; glycolate; and oxalate.

The term "randomized" as used to refer to peptide sequences refers to fully random sequences (e.g., selected by phage display methods) and sequences in which one or more residues of a naturally occurring molecule is replaced by an amino acid residue not appearing in that position in the naturally occurring molecule. Exemplary methods for identifying peptide sequences include phage display, E. coli display, ribosome display, yeast-based screening, RNA-peptide screening, chemical screening, rational design, protein structural analysis, and the like.

The term "pharmacologically active" means that a substance so described is determined to have activity that affects a medical parameter (e.g., but not limited to blood pressure, blood cell count, cholesterol level) or disease state (e.g., but not limited to cancer, autoimmune disorders). Thus, pharmacologically active peptides comprise agonistic or mimetic and antagonistic peptides as defined below.

The terms "-mimetic peptide" and "-agonist peptide" refer to a peptide having biological activity comparable to a protein (e.g., but not limited to EPO, TPO, G-CSF and other proteins described herein) that interacts with a protein of interest. These terms further include peptides that indirectly mimic the activity of a protein of interest, such as by potentiating the effects of the natural ligand of the protein of interest; see, for example, the G-CSF-mimetic peptides listed in Tables 2 and 7. As an example, the term "EPO-mimetic peptide" comprises any peptides that can be identified or derived as described in Wrighton et al. (1996), Science 273: 458-63, Naranda et al. (1999), Proc. Natl. Acad. Sci. USA 96: 7569-74, or any other reference in Table 2 identified as having EPO-mimetic subject matter. Those of ordinary skill in the art appreciate that each of these references enables one to select different peptides than actually disclosed therein by following the disclosed procedures with different peptide libraries.

As another example, the term "TPO-mimetic peptide" or "TMP" refers to peptides that can be identified or derived as described in Cwirla et al. (1997), Science 276: 1696-9, U.S. Pat. Nos. 5,869,451 and 5,932,946 and any other reference in Table 2 identified as having TPO-mimetic subject matter, as well as International application WO 00/24770 published May 4, 2000, hereby incorporated by reference. Those of ordinary skill in the art appreciate that each of these references enables one to select different peptides than actually disclosed therein by following the disclosed procedures with different peptide libraries.

As another example, the term "G-CSF-mimetic peptide" refers to any peptides that can be identified or described in Paukovits et al. (1984), Hoppe-Seylers Z. Physiol. Chem. 365: 303-11 or any of the references in Table 2 identified as having G-CSF-mimetic subject matter. Those of ordinary skill in the art appreciate that each of these references enables one to select different peptides than actually disclosed therein by following the disclosed procedures with different peptide libraries.

The term "CTLA4-mimetic peptide" refers to any peptides that can be identified or derived as described in Fukumoto et al. (1998), Nature Biotech. 16: 267-70. Those of ordinary skill in the art appreciate that each of these references enables one to select different peptides than actually disclosed therein by following the disclosed procedures with different peptide libraries.

The term "-antagonist peptide" or "inhibitor peptide" refers to a peptide that blocks or in some way interferes with the biological activity of the associated protein of interest, or has biological activity comparable to a known antagonist or inhibitor of the associated protein of interest. Thus, the term "TNF-antagonist peptide" comprises peptides that can be identified or derived as described in Takasaki et al. (1997), Nature Biotech. 15: 1266-70 or any of the references in Table 2 identified as having TNF-antagonistic subject matter. Those of ordinary skill in the art appreciate that each of these references enables one to select different peptides than actually disclosed therein by following the disclosed procedures with different peptide libraries.

The terms "IL-1 antagonist" and "IL-1ra-mimetic peptide" refers to peptides that inhibit or down-regulate activation of the IL-1 receptor by IL-1. IL-1 receptor activation results from formation of a complex among IL-1, IL-1 receptor, and IL-1 receptor accessory protein. IL-1 antagonist or IL-1ra-mimetic peptides bind to IL-1, IL-1 receptor, or IL-1 receptor accessory protein and obstruct complex formation among any two or three components of the complex. Exemplary IL-1 antagonist or IL-1ra-mimetic peptides can be identified or derived as described in U.S. Pat. Nos. 5,608,035; 5,786,331, 5,880,096; or any of the references in Table 2 identified as having IL-1ra-mimetic or IL-1 antagonistic subject matter. Those of ordinary skill in the art appreciate that each of these references enables one to select different peptides than actually disclosed therein by following the disclosed procedures with different peptide libraries.

The term "VEGF-antagonist peptide" refers to peptides that can be identified or derived as described in Fairbrother (1998), Biochem. 37: 17754-64, and in any of the references in Table 2 identified as having VEGF-antagonistic subject matter. Those of ordinary skill in the art appreciate that each of these references enables one to select different peptides than actually disclosed therein by following the disclosed procedures with different peptide libraries.

The term "MMP inhibitor peptide" refers to peptides that can be identified or derived as described in Koivunen (1999), Nature Biotech. 17: 768-74 and in any of the references in Table 2 identified as having MMP inhibitory subject matter. Those of ordinary skill in the art appreciate that each of these references enables one to select different peptides than actually disclosed therein by following the disclosed procedures with different peptide libraries.

The term "myostatin inhibitor peptide" refers to peptides that can be identified by their ability to reduce or block myostatin activity or signaling as demonstrated in in vitro assays such as, for example the pMARE C2C12 cell-based myostatin activity assay or by in vivo animal testing as described in U.S. patent application Publication No US20040181033A1 and PCT application publication No. WO2004/058988. Exemplary myostatin inhibitor peptides are set out in Tables 21-24.

The term "integrin/adhesion antagonist" refers to peptides that inhibit or down-regulate the activity of integrins, selectins, cell adhesion molecules, integrin receptors, selectin receptors, or cell adhesion molecule receptors. Exemplary integrin/adhesion antagonists comprise laminin, echistatin, the peptides described in Tables 25-28.

The term "bone resorption inhibitor" refers to such molecules as determined by the assays of Examples 4 and 11 of WO 97/23614: which is hereby incorporated by reference in its entirety. Exemplary bone resorption inhibitors include OPG and OPG-L antibody, which are described in WO 97/23614 and WO98/46751, respectively, which are hereby incorporated by reference in their entirety.

The term "nerve growth factor inhibitor" or "nerve growth factor agonist" refers to a peptide that binds to and inhibits nerve growth factor (NGF) activity or signaling. Exemplary peptides of this type are set out in Table 29.

The term "TALL-1 modulating domain" refers to any amino acid sequence that binds to the TALL-1 and comprises naturally occurring sequences or randomized sequences. Exemplary TALL-1 modulating domains can be identified or derived by phage display or other methods mentioned herein. Exemplary peptides of this type are set out in Tables 30 and 31.

The term "TALL-1 antagonist" refers to a molecule that binds to the TALL-1 and increases or decreases one or more assay parameters opposite from the effect on those parameters by full length native TALL-1. Such activity can be determined, for example, by such assays as described in the subsection entitled "Biological activity of AGP-3" in the Materials & Methods section of the patent application entitled, "TNF-RELATED PROTEINS", WO 00/47740, published Aug. 17, 2000.

The term "Ang 2-antagonist peptide" refers to peptides that can be identified or derived as having Ang-2-antagonistic characteristics. Exemplary peptides of this type are set out in Tables 32-38.

The term "WSP" refers to a water soluble polymer which prevents a peptide, protein or other compound to which it is attached from precipitating in an aqueous environment, such as, by way of example, a physiological environment. A more detailed description of various WSP embodiments contemplated by the invention follows.

Lyophilization and Administration

Therapeutic peptibodies are useful in pharmaceutical formulations in order to treat human diseases as described herein. In one embodiment the therapeutic peptibody compositions are lyophilized. Lyophilization is carried out using techniques common in the art and should be optimized for the composition being developed [Tang et al., Pharm Res. 21:191-200, (2004) and Chang et al., Pharm Res. 13:243-9 (1996)].

A lyophilization cycle is, in one aspect, composed of three steps: freezing, primary drying, and secondary drying [A. P. Mackenzie, Phil Trans R Soc London, Ser B, Biol 278:167 (1977)]. In the freezing step, the solution is cooled to initiate ice formation. Furthermore, this step induces the crystallization of the bulking agent. The ice sublimes in the primary drying stage, which is conducted by reducing chamber pressure below the vapor pressure of the ice, using a vacuum and introducing heat to promote sublimation. Finally, adsorbed or bound water is removed at the secondary drying stage under reduced chamber pressure and at an elevated shelf temperature. The process produces a material known as a lyophilized cake. Thereafter the cake can be reconstituted with either sterile water or suitable diluent for injection.

The lyophilization cycle not only determines the final physical state of the excipients but also affects other parameters such as reconstitution time, appearance, stability and final moisture content. The composition structure in the frozen state proceeds through several transitions (e.g., glass transitions, wettings, and crystallizations) that occur at specific temperatures and can be used to understand and optimize the lyophilization process. The glass transition temperature (Tg and/or Tg') can provide information about the physical state of a solute and can be determined by differential scanning calorimetry (DSC). Tg and Tg' are an important parameter that must be taken-into account when designing the lyophilization cycle. For example, Tg' is important for primary drying. Furthermore, in the dried state, the glass transition temperature provides information on the storage temperature of the final product.

Excipients in General

Excipients are additives that are included in a formulation because they either impart or enhance the stability, delivery and manufacturability of a drug product. Regardless of the reason for their inclusion, excipients are an integral component of a drug product and therefore need to be safe and well tolerated by patients. For protein drugs, the choice of excipients is particularly important because they can affect both efficacy and immunogenicity of the drug. Hence, protein formulations need to be developed with appropriate selection of excipients that afford suitable stability, safety, and marketability.

A lyophilized formulation is usually comprised of a buffer, a bulking agent, and a stabilizer. The utility of a surfactant may be evaluated and selected in cases where aggregation during the lyophilization step or during reconstitution becomes an issue. An appropriate buffering agent is included to maintain the formulation within stable zones of pH during lyophilization. A comparison of the excipient components in liquid and lyophilized protein formulations is provided in Table A.

TABLE A

| Excipient components of lyophilized protein formulations | |
|---|---|
| Excipient component | Function in lyophilized formulation |
| Buffer | Maintain pH of formulation during lyophilization and upon reconstitution |
| Tonicity agent/stabilizer | Stabilizers include cryo and lyoprotectants Examples include Polyols, sugars and polymers Cryoprotectants protect proteins from freezing stresses Lyoprotectants stabilize proteins in the freeze-dried state |
| Bulking agent | Used to enhance product elegance and to prevent blowout Provides structural strength to the lyo cake Examples include mannitol and glycine |
| Surfactant | Employed if aggregation during the lyophilization process is an issue May serve to reduce reconstitution times Examples include polysorbate 20 and 80 |
| Anti-oxidant | Usually not employed, molecular reactions in the lyo cake are greatly retarded |

TABLE A-continued

Excipient components of lyophilized protein formulations

| Excipient component | Function in lyophilized formulation |
|---|---|
| Metal ions/chelating agent | May be included if a specific metal ion is included only as a co-factor or where the metal is required for protease activity Chelating agents are generally not needed in lyo formulations |
| Preservative | For multi-dose formulations only Provides protection against microbial growth in formulation Is usually included in the reconstitution diluent (e.g. bWFI) |

The principal challenge in developing formulations for therapeutic proteins is stabilizing the product against the stresses of manufacturing, shipping and storage. The role of formulation excipients is to provide stabilization against these stresses. Excipients may also be employed to reduce viscosity of high concentration protein formulations in order to enable their delivery and enhance patient convenience. In general, excipients can be classified on the basis of the mechanisms by which they stabilize proteins against various chemical and physical stresses. Some excipients are used to alleviate the effects of a specific stress or to regulate a particular susceptibility of a specific protein. Other excipients have more general effects on the physical and covalent stabilities of proteins. The excipients described herein are organized either by their chemical type or their functional role in formulations. Brief descriptions of the modes of stabilization are provided when discussing each excipient type.

Given the teachings and guidance provided herein, those skilled in the art will know what amount or range of excipient can be included in any particular formulation to achieve a biopharmaceutical formulation of the invention that promotes retention in stability of the biopharmaceutical. For example, the amount and type of a salt to be included in a biopharmaceutical formulation of the invention can be selected based on to the desired osmolality (i.e., isotonic, hypotonic or hypertonic) of the final solution as well as the amounts and osmolality of other components to be included in the formulation. Similarly, by exemplification with reference to the type of polyol or sugar included in a formulation, the amount of such an excipient will depend on its osmolality.

By way of example, inclusion of about 5% sorbitol can achieve isotonicity while about 9% of a sucrose excipient is needed to achieve isotonicity. Selection of the amount or range of concentrations of one or more excipients that can be included within a biopharmaceutical formulation of the invention has been exemplified above by reference to salts, polyols and sugars. However, those skilled in the art will understand that the considerations described herein and further exemplified by reference to specific excipients are equally applicable to all types and combinations of excipients including, for example, salts, amino acids, other tonicity agents, surfactants, stabilizers, bulking agents, cryoprotectants, lyoprotectants, anti-oxidants, metal ions, chelating agents and/or preservatives.

Further, where a particular excipient is reported in a formulation by, e.g., percent (%) w/v, those skilled in the art will recognize that the equivalent molar concentration of that excipient is also contemplated.

Of course, a person having ordinary skill in the art would recognize that the concentrations of the aforementioned excipients share an interdependency within a particular formulation. By way of example, the concentration of a bulking agent may be lowered where, e.g., there is a high protein/peptide concentration or where, e.g., there is a high stabilizing agent concentration. In addition, a person having ordinary skill in the art would recognize that, in order to maintain the isotonicity of a particular formulation in which there is no bulking agent, the concentration of a stabilizing agent would be adjusted accordingly (i.e., a "tonicifying" amount of stabilizer would be used). Other excipients are known in the art and can be found in Powell et al., Compendium of Excipients fir Parenteral Formulations (1998), PDA J. Pharm. Sci. Technology, 52:238-311.

Buffers

The stability of a protein drug is usually observed to be maximal in a narrow pH range. This pH range of optimal stability needs to be identified early during pre-formulation studies. Several approaches such as accelerated stability studies and calorimetric screening studies have been demonstrated to be useful in this endeavor (Remmele R. L. Jr., et al., Biochemistry, 38(16): 5241-7 (1999)). Once a formulation is finalized, the drug product must be manufactured and maintained within a predefined specification throughout its shelf-life. Hence, buffering agents are almost always employed to control pH in the formulation.

Organic acids, phosphates and Tris have been employed routinely as buffers in protein formulations (Table B). The buffer capacity of the buffering species is maximal at a pH equal to the pKa and decreases as pH increases or decreases away from this value. Ninety percent of the buffering capacity exists within one pH unit of its pKa. Buffer capacity also increases proportionally with increasing buffer concentration.

Several factors need to be considered when choosing a buffer. First and foremost, the buffer species and its concentration need to be defined based on its pKa and the desired formulation pH. Equally important is to ensure that the buffer is compatible with the protein drug, other formulation excipients, and does not catalyze any degradation reactions. Recently, polyanionic carboxylate buffers such as citrate and succinate have been shown to form covalent adducts with the side chain residues of proteins. A third important aspect to be considered is the sensation of stinging and irritation the buffer may induce. For example, citrate is known to cause stinging upon injection (Laursen T, et al., Basic Clin Pharmacol Toxicol., 98(2): 218-21 (2006)). The potential for stinging and irritation is greater for drugs that are administered via the SC or IM routes, where the drug solution remains at the site for a relatively longer period of time than when administered by the IV route where the formulation gets diluted rapidly into the blood upon administration. For formulations that are administered by direct IV infusion, the total amount of buffer (and any other formulation component) needs to be monitored. One has to be particularly careful about potassium ions administered in the form of the potassium phosphate buffer, which can induce cardiovascular effects in a patient (Hollander-Rodriguez J C, et al., Am. Fam. Physician., 73(2): 283-90 (2006)).

Buffers for lyophilized formulations need additional consideration. Some buffers like sodium phosphate can crystallize out of the protein amorphous phase during freezing resulting in rather large shifts in pH. Other common buffers such as acetate and imidazole should be avoided since they may sublime or evaporate during the lyophilization process, thereby shifting the pH of formulation during lyophilization or after reconstitution.

TABLE B

Commonly used buffering agents and their $pK_a$ values

| Buffer | $pK_a$ | Example drug product |
|---|---|---|
| Acetate | 4.8 | Neupogen, Neulasta |
| Succinate | $pK_{a1} = 4.8, pK_{a2} = 5.5$ | Actimmune |
| Citrate | $pK_{a1} = 3.1, pK_{a2} = 4.8, pK_{a3} = 6.4$ | Humira |
| Histidine (imidazole) | 6.0 | Xolair |
| phosphate | $pK_{a1} = 2.15, pK_{a2} = 7.2, pK_{a3} = 12.3$ | Enbrel (liquid formulation) |
| Tris | 8.1 | Leukine |

The buffer system present in the compositions is selected to be physiologically compatible and to maintain a desired pH in the reconstituted solution as well as in the solution before lyophilization. In one embodiment, the pH of the solution prior to lyophilization is between pH 2.0 and pH 12.0. For example, in one embodiment the pH of the solution prior to lyophilization is 2.0, 2.3, 2.5, 2.7, 3.0, 3.3, 3.5, 3.7, 4.0, 4.3, 4.5, 4.7, 5.0, 5.3, 5.5, 5.7, 6.0, 6.3, 6.5, 6.7, 7.0, 7.3, 7.5, 7.7, 8.0, 8.3, 8.5, 8.7, 9.0, 9.3, 9.5, 9.7, 10.0, 10.3, 10.5, 10.7, 11.0, 11.3, 11.5, 11.7, or 12.0. In another embodiment, the pH of the reconstituted solution is between 4.5 and 9.0. In one embodiment, the pH in the reconstituted solution is 4.5, 4.7, 5.0, 5.3, 5.5, 5.7, 6.0, 6.3, 6.5, 6.7, 7.0, 7.3, 7.5, 7.7, 8.0, 8.3, 8.5, 8.7, or 9.0.

In one embodiment, the pH buffering agent used in the formulation is an amino acid or mixture of amino acids. In one aspect, the pH buffering agent is histidine or a mixture of amino acids one of which is histidine.

The pH buffering compound may be present in any amount suitable to maintain the pH of the formulation at a predetermined level. In one embodiment, when the pH buffering agent is an amino acid, the concentration of the amino acid is between 0.1 mM and 1000 mM (1 M). In one embodiment, the pH buffering agent is at least 0.1, 0.5, 0.7, 0.8 0.9, 1.0, 1.2, 1.5, 1.7, 2, 3, 4, 5, 6, 7, 8, 9, 10, 11, 12, 13, 14, 15, 16, 17, 18, 19, 20, 30, 40, 50, 60, 70, 80, 90, 100, 200, 500, 700, or 900 mM. In another embodiment, the concentration of the pH buffering agent is between 1, 1.2, 1.5, 1.7, 2, 3, 4, 5, 6, 7, 8, 9, 10, 11, 12, 13, 14, 15, 16, 17, 18, 19, 20, 30, 40, 50, 60, 70, 80, or 90 mM and 100 mM. In still another embodiment, the concentration of the pH buffering agent is between 5, 6, 7, 8, 9, 10, 11, 12, 13, 14, 15, 16, 17, 18, 19, 20, 30, or 40 mM and 50 mM. In yet another embodiment, the concentration of the pH buffering agent is 10 mM.

Other exemplary pH buffering agents used to buffer the formulation as set out herein include, but are not limited to glycine, histidine, glutamate, succinate, phosphate, acetate, and aspartate.

Stabilizers and Bulking Agents

Bulking agents are typically used in lyophilized formulations to enhance product elegance and to prevent blowout. Conditions in the formulation are generally designed so that the bulking agent crystallizes out of the frozen amorphous phase (either during freezing or annealing above the Tg') giving the cake structure and bulk. Mannitol and glycine are examples of commonly used bulking agents.

Stabilizers include a class of compounds that can serve as cryoprotectants, lyoprotectants, and glass forming agents. Cryoprotectants act to stabilize proteins during freezing or in the frozen state at low temperatures (P. Cameron, ed., Good Pharmaceutical Freeze-Drying Practice, Interpharm Press, Inc., Buffalo Grove, Ill., (1997)). Lyoprotectants stabilize proteins in the freeze-dried solid dosage form by preserving the native-like conformational properties of the protein during dehydration stages of freeze-drying. Glassy state properties have been classified as "strong" or "fragile" depending on their relaxation properties as a function of temperature. It is important that cryoprotectants, lyoprotectants, and glass forming agents remain in the same phase with the protein in order to impart stability. Sugars, polymers, and polyols fall into this category and can sometimes serve all three roles.

Polyols encompass a class of excipients that includes sugars, (e.g. mannitol, sucrose, sorbitol), and other polyhydric alcohols (e.g., glycerol and propylene glycol). The polymer polyethylene glycol (PEG) is included in this category. Polyols are commonly used as stabilizing excipients and/or isotonicity agents in both liquid and lyophilized parenteral protein formulations. With respect to the Hofmeister series, the polyols are kosmotropic and are preferentially excluded from the protein surface. Polyols can protect proteins from both physical and chemical degradation pathways. Preferentially excluded co-solvents increase the effective surface tension of solvent at the protein interface whereby the most energetically favorable protein conformations are those with the smallest surface areas.

Mannitol is a popular bulking agent in lyophilized formulations because it crystallizes out of the amorphous protein phase during freeze-drying lending structural stability to the cake (e.g. Leukine®, Enbrel®—Lyo, Betaseron®). It is generally used in combination with a cryo and/or lyoprotectant like sucrose. Because of the propensity of mannitol to crystallize under frozen conditions, sorbitol and sucrose are the preferred tonicity agents/stabilizers in liquid formulations to protect the product against freeze-thaw stresses encountered during transport or when freezing bulk prior to manufacturing. Sorbitol and sucrose are far more resistant to crystallization and therefore less likely to phase separate from the protein. It is interesting to note that while mannitol has been used in tonicifying amounts in several marketed liquid formulations such as Actimmune®, Forteo®, and Rebif®, the product labels of these drugs carry a 'Do Not Freeze' warning. The use of reducing sugars (containing free aldehyde or ketone groups) such as glucose and lactose should be avoided because they can react and glycate surface lysine and arginine residues of proteins via the Maillard reaction of aldehydes and primary amines (Chevalier F, et al., *Nahrung*, 46(2): 58-63 (2002); Humeny A, et al., *J Agric Food Chem.* 50(7): 2153-60 (2002)). Sucrose can hydrolyze to fructose and glucose under acidic conditions (Kautz C. F. and Robinson A. L., *JACS,* 50(4) 1022-30 (1928)), and consequently may cause glycation.

The polymer polyethylene glycol (PEG) could stabilize proteins by two different temperature dependent mechanisms. At lower temperatures, it is preferentially excluded from the protein surface but has been shown to interact with the unfolded form of the protein at higher temperature given its amphipathic nature (Lee L. L., and Lee J. C., *Biochemistry,* 26(24): 7813-9 (1987)). Thus at lower temperatures it may protect proteins via the mechanism of preferential exclusion, but at higher temperatures possibly by reducing the number of productive collisions between unfolded molecules. PEG is also a cryoprotectant and has been employed in Recombinate®, a lyophilized formulation of recombinant Antihemophilic Factor, which utilizes PEG 3350 at a concentration of 1.5 mg/mL. The low molecular weight liquid PEGs (PEG 300-600) can be contaminated with peroxides and cause protein oxidation. If used, the peroxide content in the raw material must be minimized and controlled throughout its shelf-life. The same holds true for polysorbates.

In a particular embodiment of the present compositions, a stabilizer (or a combination of stabilizers) is added to the lyophilization formulation to prevent or reduce lyophilization-induced or storage-induced aggregation and chemical degradation. A hazy or turbid solution upon reconstitution indicates that the protein has precipitated. The term "stabilizer" means an excipient capable of preventing aggregation or other physical degradation, as well as chemical degradation (for example, autolysis, deamidation, oxidation, etc.) in an aqueous and solid state. Stabilizers that are conventionally employed in pharmaceutical compositions include, but are not limited to, sucrose, trehalose, mannose, maltose, lactose, glucose, raffinose, cellobiose, gentiobiose, isomaltose, arabinose, glucosamine, fructose, mannitol, sorbitol, glycine, arginine HCL, poly-hydroxy compounds, including polysaccharides such as dextran, starch, hydroxyethyl starch, cyclodextrins, N-methylpyrollidene, cellulose and hyaluronic acid, sodium chloride, [Carpenter et al., Develop. Biol. Standard 74:225, (1991)]. In one embodiment, the stabilizer is incorporated in a concentration of about 0% to about 40% w/v. In another embodiment, the stabilizer is incorporated in a concentration of at least 0.5, 1, 2, 3, 4, 5, 6, 7, 8, 9, 10, 11, 12, 13, 14, 15, 16, 17, 18, 19, 20, 30, or 40% w/v. In another embodiment, the stabilizer is incorporated in a concentration of about 1, 2, 3, 4, 5, 6, 7, 8, 9% to about 10% w/v. In still another embodiment, the stabilizer is incorporated in a concentration of about 2% to about 4% w/v. In yet another embodiment, the stabilizer is incorporated in a concentration of about 2% W/V.

If desired, the lyophilized compositions also include appropriate amounts of bulking and osmolarity regulating agents suitable for forming a lyophilized "cake". Bulking agents may be either crystalline (for example, mannitol, glycine) or amorphous (for example, sucrose, polymers such as dextran, polyvinylpyrolidone, carboxymethylcellulose). Other exemplary bulking agents include lactose, sorbitol, trehalose, or xylitol. In one embodiment, the bulking agent is mannitol. In a further embodiment, the bulking agent is incorporated in a concentration of about 0% to about 10% w/v. In another embodiment, the bulking agent is incorporated in a concentration of at least 0.2, 0.5, 0.7, 1.0, 1.5, 2.0, 2.5, 3.0, 3.5, 4.0, 4.5, 5.0, 5.5, 6.0, 6.5, 7.0, 7.5, 8.0, 8.5, 9.0, or 9.5% w/v. In a yet further embodiment in a concentration of about 1, 1.5, 2.0, 2.5, 3.0, 3.5, 4.0, 4.5% to 5.0% w/v, to produce a mechanically and pharmaceutically stable and elegant cake. In another embodiment, the mannitol concentration is 4% w/v.

Surfactants

Protein molecules have a high propensity to interact with surfaces making them susceptible to adsorption and denaturation at air-liquid, vial-liquid, and liquid-liquid (silicone oil) interfaces. This degradation pathway has been observed to be inversely dependent on protein concentration and result in either the formation of soluble and insoluble protein aggregates or the loss of protein from solution via adsorption to surfaces. In addition to container surface adsorption, surface-induced degradation is exacerbated with physical agitation, as would be experienced during shipping and handling of the product.

Surfactants are commonly used in protein formulations to prevent surface-induced degradation. Surfactants are amphipathic molecules with the capability of out-competing proteins for interfacial positions. Hydrophobic portions of the surfactant molecules occupy interfacial positions (e.g., air/liquid), while hydrophilic portions of the molecules remain oriented towards the bulk solvent. At sufficient concentrations (typically around the detergent's critical micellar concentration), a surface layer of surfactant molecules serve to prevent protein molecules from adsorbing at the interface. Thereby, surface-induced degradation is minimized. The most commonly used surfactants are fatty acid esters of sorbitan polyethoxylates, i.e. polysorbate 20 and polysorbate 80 (e.g., Avonex®, Neupogen®, Neulasta®). The two differ only in the length of the aliphatic chain that imparts hydrophobic character to the molecules, C-12 and C-18, respectively. Accordingly, polysorbate-80 is more surface-active and has a lower critical micellar concentration than polysorbate-20. The surfactant poloxamer 188 has also been used in several marketed liquid products such Gonal-F®, Norditropin®, and Ovidrel®.

Detergents can also affect the thermodynamic conformational stability of proteins. Here again, the effects of a given excipient will be protein specific. For example, polysorbates have been shown to reduce the stability of some proteins and increase the stability of others. Detergent destabilization of proteins can be rationalized in terms of the hydrophobic tails of the detergent molecules that can engage in specific binding with partially or wholly unfolded protein states. These types of interactions could cause a shift in the conformational equilibrium towards the more expanded protein states (i.e. increasing the exposure of hydrophobic portions of the protein molecule in complement to binding polysorbate). Alternatively, if the protein native state exhibits some hydrophobic surfaces, detergent binding to the native state may stabilize that conformation.

Another aspect of polysorbates is that they are inherently susceptible to oxidative degradation. Often, as raw materials, they contain sufficient quantities of peroxides to cause oxidation of protein residue side-chains, especially methionine. The potential for oxidative damage arising from the addition of stabilizer emphasizes the point that the lowest effective concentrations of excipients should be used in formulations. For surfactants, the effective concentration for a given protein will depend on the mechanism of stabilization. It has been postulated that if the mechanism of surfactant stabilization is related to preventing surface-denaturation the effective concentration will be around the detergent's critical micellar concentration. Conversely, if the mechanism of stabilization is associated with specific protein-detergent interactions, the effective surfactant concentration will be related to the protein concentration and the stoichiometry of the interaction (Randolph T. W., et al., *Pharm Biotechnol.*, 13:159-75 (2002)).

Surfactants may also be added in appropriate amounts to prevent surface related aggregation phenomenon during freezing and drying [Chang, B, J. Pharm. Sci. 85:1325, (1996)]. Exemplary surfactants include anionic, cationic, nonionic, zwitterionic, and amphoteric surfactants including surfactants derived from naturally-occurring amino acids. Anionic surfactants include, but are not limited to, sodium lauryl sulfate, dioctyl sodium sulfosuccinate and dioctyl sodium sulfonate, chenodeoxycholic acid, N-lauroylsarcosine sodium salt, lithium dodecyl sulfate, 1-octanesulfonic acid sodium salt, sodium cholate hydrate, sodium deoxycholate, and glycodeoxycholic acid sodium salt. Cationic surfactants include, but are not limited to, benzalkonium chloride or benzethonium chloride, cetylpyridinium chloride monohydrate, and hexadecyltrimethylammonium bromide. Zwitterionic surfactants include, but are not limited to, CHAPS, CHAPSO, SB3-10, and SB3-12. Non-ionic surfactants include, but are not limited to, digitonin, Triton X-100, Triton X-114, TWEEN-20, and TWEEN-80. In another embodiment, surfactants include lauromacrogol 400, polyoxyl 40 stearate, polyoxyethylene hydrogenated castor oil 10, 40, 50 and 60, glycerol monostearate, polysorbate 40, 60, 65 and 80, soy lecithin and other phospholipids such as DOPC, DMPG, DMPC, and DOPG; sucrose fatty acid ester, methyl cellulose and carboxymethyl cellulose. Compositions comprising these surfactants, either individually or as a mixture in different ratios, are therefore further provided. In one embodiment, the surfactant is incorporated in a concentration of about 0% to about 5% w/v. In another embodiment, the surfactant is incorporated in a concentration of at least 0.001, 0.002, 0.005, 0.007, 0.01, 0.05, 0.1, 0.2, 0.3, 0.4, 0.5, 0.6, 0.7, 0.7, 0.8, 0.9, 1.0, 1.5, 2.0, 2.5, 3.0, 3.5, 4.0, or 4.5% w/v. In another embodiment, the surfactant is incorporated in a concentration of about 0.001% to about 0.5% w/v. In still another embodiment, the surfactant is incorporated in a concentration of about 0.004, 0.005, 0.007, 0.01, 0.05, or 0.1% w/v to about 0.2% w/v. In yet another embodiment, the surfactant is incorporated in a concentration of about 0.01% to about 0.1% w/v.

Salts

Salts are often added to increase the ionic strength of the formulation, which can be important for protein solubility, physical stability, and isotonicity. Salts can affect the physical stability of proteins in a variety of ways. Ions can stabilize the native state of proteins by binding to charged residues on the protein's surface. Alternatively, they can stabilize the denatured state by binding to the peptide groups along the protein backbone (—CONH—). Salts can also stabilize the protein native conformation by shielding repulsive electrostatic interactions between residues within a protein molecule. Electrolytes in protein formulations can also shield attractive electrostatic interactions between protein molecules that can lead to protein aggregation and insolubility.

The effect of salt on the stability and solubility of proteins varies significantly with the characteristics of the ionic species. The Hofmeister series originated in the 1880's as a way to rank order electrolytes based on their ability to precipitate proteins (Cacace M. G., et al., *Quarterly Reviews of Biophysics*, 30(3): 241-277 (1997)). In this report, the Hofmeister series is used to illustrate a scale of protein stabilization effects by ionic and non-ionic co-solutes. In Table C, co-solutes are ordered with respect to their general effects on solution state proteins, from stabilizing (kosmotropic) to destabilizing (chaotropic). In general, the differences in effects across the anions are far greater than that observed for the cations, and, for both types, the effects are most apparent at higher concentrations than are acceptable in parenteral formulations. High concentrations of kosmotropes (e.g., >1 molar ammonium sulfate) are commonly used to precipitate proteins from solution by a process called 'salting-out' where the kosmotrope is preferentially excluded from the protein surface reducing the solubility of the protein in it's native (folded) conformation. Removal or dilution of the salt will return the protein to solution. The term 'salting-in' refers to the use of destabilizing ions (e.g., like guanidine and chloride) that increase the solubility of proteins by solvating the peptide bonds of the protein backbone. Increasing concentrations of the chaotrope will favor the denatured (unfolded) state conformation of the protein as the solubility of the peptide chain increases. The relative effectiveness of ions to 'salt-in' and 'salt-out' defines their position in the Hofmeister series.

In order to maintain isotonicity in a parenteral formulation, salt concentrations are generally limited to less than 150 mM for monovalent ion combinations. In this concentration range, the mechanism of salt stabilization is probably due to screening of electrostatic repulsive intramolecular forces or attractive intermolecular forces (Debye-Huckel screening). Interestingly, chaotropic salts have been shown to be more effective at stabilizing the protein structure than similar concentrations of kosmotropes by this mechanism. The chaotropic anions are believed to bind more strongly than the kosmotropic ions. With respect to covalent protein degradation, differential effects of ionic strength on this mechanism are expected through Debye-Huckel theory. Accordingly, published reports of protein stabilization by sodium chloride are accompanied by those where sodium chloride accelerated covalent degradation. The mechanisms by which salts affect protein stability are protein specific and may vary significantly as a function of solution pH. An example where an excipient can be useful in enabling the delivery of a protein drug is that of some high concentration antibody formulations. Recently; salts have been shown to be effective in reducing the viscosity of such formulations (Liu J., et al., *J. Pharm Sci.*, 94(9): 1928-40 (2005); Erratum in: *J. Pharm Sci.*, 95(1): 234-5. (2006)).

TABLE C

The Hofmeister series of salts

| Cosolute | | | Stabilization scales | |
|---|---|---|---|---|
| Anion | Cation | Other | | |
| $F^-$ | $(CH_3)_4N^+$ | Glycerol/Sorbitol | Stabilizing (salting-out) | Kosmotropic |
| $PO_4^-$ | $(CH_3)_2NH^+$ | Sucrose/Trehalose | | |
| $SO_4^-$ | $NH_4^+$ | TMAO | | |
| $CHCOO^-$ | $K^+$ | | | |
| $Cl^-$ | $Na^+$ | | | |
| $Br^-$ | $Cs^+$ | | | |
| $I^-$ | $Li^+$ | | | |
| | $Mg^{2+}$ | Guanidine | | |
| | $Ca^{2+}$ | Arginine | | |
| | $Ba^{2+}$ | Urea | Destabilizing (salting-in) | Chaotropic |

Amino Acids

Amino acids have found versatile use in protein formulations as buffers, bulking agents, stabilizers and antioxidants. Histidine and glutamic acid are employed to buffer protein formulations in the pH range of 5.5-6.5 and 4.0-5.5 respectively. The imidazole group of histidine has a pKa=6.0 and the carboxyl group of glutamic acid side chain has a pKa of 4.3 which makes them suitable for buffering in their respective pH ranges. Acetate, the most commonly used buffer in the acidic pH range of 4.0-5.5, sublimates during lyophilization and hence should not be used in freeze-dried formulations. Glutamic acid is particularly useful in such cases (e.g., Stemgen®). Histidine is commonly found in marketed protein formulations (e.g., Xolair®, Herceptin®, Recombinate®). It provides a good alternative to citrate, a buffer known to sting upon injection. Interestingly, histidine has also been reported to have a stabilizing effect on ABX-IL8 (an IgG2 antibody) with respect to aggregation when used at high concentrations in both liquid and lyophilized presentations (Chen B, et al., *Pharm Res.*, 20(12): 1952-60 (2003)). Histidine (up to 60 mM) was also observed to reduce the viscosity of a high concentration formulation of this antibody. However, in the same study, the authors observed increased aggregation and discoloration in histidine containing formulations during freeze-thaw studies of the antibody in stainless steel containers. The authors attributed this to an effect of iron ions leached from corrosion of steel containers. Another note of caution with histidine is that it undergoes photo-oxidation in the presence of metal ions (Tomita M, et al., *Biochemistry*, 8(12): 5149-60 (1969)). The use of methionine as an antioxidant in formulations appears promising; it has been observed to be effective against a number of oxidative stresses (Lam X M, et al., *J Pharm Sci.*, 86(11): 1250-5 (1997)).

The amino acids glycine, proline, serine and alanine have been shown to stabilize proteins by the mechanism of preferential exclusion. Glycine is also a commonly used bulking agent in lyophilized formulations (e.g., Neumega®, Genotropin®, Humatrope®). It crystallizes out of the frozen amorphous phase giving the cake structure and bulk. Arginine has been shown to be an effective agent in inhibiting aggregation and has been used in both liquid and lyophilized formulations (e.g., Activase®, Avonex®, Enbrel® liquid). Furthermore, the enhanced efficiency of refolding of certain proteins in the presence of arginine has been attributed to its suppression of the competing aggregation reaction during refolding.

Antioxidants

Oxidation of protein residues arises from a number of different sources. Beyond the addition of specific antioxidants, the prevention of oxidative protein damage involves the careful control of a number of factors throughout the manufacturing process and storage of the product such as atmospheric oxygen, temperature, light exposure, and chemical contamination. The most commonly used pharmaceutical antioxidants are reducing agents, oxygen/free-radical scavengers, or chelating agents. Antioxidants in therapeutic protein formulations must be water-soluble and remain active throughout the product shelf-life. Reducing agents and oxygen/free-radical scavengers work by ablating active oxygen species in solution. Chelating agents such as EDTA can be effective by binding trace metal contaminants that promote free-radical formation. For example, EDTA was utilized in the liquid formulation of acidic fibroblast growth factor to inhibit the metal ion catalyzed oxidation of cysteine residues. EDTA has been used in marketed products like Kineret® and Ontak®.

In addition to evaluating the effectiveness of various excipients at preventing protein oxidation, formulation scientists must be aware of the potential for the antioxidants themselves to induce other covalent or physical changes to the protein. A number of such cases have been reported in the literature. Reducing agents (like glutathione) can cause disruption of intramolecular disulfide linkages, which can lead to disulfide shuffling. In the presence of transition metal ions, ascorbic acid and EDTA have been shown to promote methionine oxidation in a number of proteins and peptides (Akers M J, and Defelippis M R. Peptides and Proteins as Parenteral Solutions. In: Pharmaceutical Formulation Development of Peptides and Proteins. Sven Frokjaer, Lars Hovgaard, editors. Pharmaceutical Science. Taylor and Francis, U K (1999)); Fransson J. R., *J. Pharm. Sci.* 86(9): 4046-1050 (1997); Yin J, et al., *Pharm Res.*, 21(12): 2377-83 (2004)). Sodium thiosulfate has been reported to reduce the levels of light and temperature induced methionine-oxidation in rhuMab HER2; however, the formation of a thiosulfate-protein adduct was also reported in this study (Lam X M, Yang J Y, et al., *J Pharm Sci.* 86(11): 1250-5 (1997)). Selection of an appropriate antioxidant is made according to the specific stresses and sensitivities of the protein.

Metal Ions

In general, transition metal ions are undesired in protein formulations because they can catalyze physical and chemical degradation reactions in proteins. However, specific metal ions are included in formulations when they are co-factors to proteins and in suspension formulations of proteins where they form coordination complexes (e.g., zinc suspension of insulin). Recently, the use of magnesium ions (10-120 mM) has been proposed to inhibit the isomerization of aspartic acid to isoaspartic acid (WO 2004039337).

Two examples where metal ions confer stability or increased activity in proteins are human deoxyribonuclease (rhDNase, Pulmozyme®), and Factor VIII. In the case of rhDNase, $Ca^{+2}$ ions (up to 100 mM) increased the stability of the enzyme through a specific binding site (Chen B, et al., *J Pharm Sci.*, 88(4): 477-82 (1999)). In fact, removal of calcium ions from the solution with EGTA caused an increase in deamidation and aggregation. However, this effect was observed only with $Ca^{+2}$ ions; other divalent cations —$Mg^{+2}$, $Mn^{+2}$ and $Zn^{+2}$ were observed to destabilize rhDNase. Similar effects were observed in Factor VIII. $Ca^{+2}$ and $Sr^{+2}$ ions stabilized the protein while others like $Mg^{+2}$, $Mn^{+2}$ and $Zn^{+2}$, $Cu^{+2}$ and $Fe^{+2}$ destabilized the enzyme (Fatouros, A., et al., *Int. J. Pharm.*, 155, 121-131 (1997). In a separate study with Factor VIII, a significant increase in aggregation rate was observed in the presence of $Al^{+3}$ ions (Derrick T S, et al., *J. Pharm. Sci.*, 93(10): 2549-57 (2004)). The authors note that other excipients like buffer salts are often contaminated with $Al^{+3}$ ions and illustrate the need to use excipients of appropriate quality in formulated products.

Preservatives

Preservatives are necessary when developing multi-use parenteral formulations that involve more than one extraction from the same container. Their primary function is to inhibit microbial growth and ensure product sterility throughout the shelf-life or term of use of the drug product. Commonly used preservatives include benzyl alcohol, phenol and m-cresol. Although preservatives have a long history of use, the development of protein formulations that includes preservatives can be challenging. Preservatives almost always have a destabilizing effect (aggregation) on proteins, and this has become a major factor in limiting their use in multi-dose protein formulations (Roy S, et al., *J Pharm Sci.*, 94(2): 382-96 (2005)).

To date, most protein drugs have been formulated for single-use only. However, when multi-dose formulations are possible, they have the added advantage of enabling patient convenience, and increased marketability. A good example is that of human growth hormone (hGH) where the development of preserved formulations has led to commercialization of more convenient, multi-use injection pen presentations. At least four such pen devices containing preserved formulations of hGH are currently available on the market. Norditropin® (liquid, Novo Nordisk), Nutropin AQ® (liquid, Genentech) & Genotropin (lyophilized—dual chamber cartridge, Pharmacia & Upjohn) contain phenol while Somatrope® (Eli Lilly) is formulated with m-cresol.

Several aspects need to be considered during the formulation development of preserved dosage forms. The effective preservative concentration in the drug product must be optimized. This requires testing a given preservative in the dosage form with concentration ranges that confer anti-microbial effectiveness without compromising protein stability. For example, three preservatives were successfully screened in the development of a liquid formulation for interleukin-1 receptor (Type I), using differential scanning calorimetry (DSC). The preservatives were rank ordered based on their impact on stability at concentrations commonly used in marketed products (Remmele R L Jr., et al., *Pharm Res.*, 15(2): 200-8 (1998)).

As might be expected, development of liquid formulations containing preservatives are more challenging than lyophilized formulations. Freeze-dried products can be lyophilized without the preservative and reconstituted with a preservative containing diluent at the time of use. This shortens the time for which a preservative is in contact with the protein significantly minimizing the associated stability risks. With liquid formulations, preservative effectiveness and stability have to be maintained over the entire product shelf-life (~18-24 months). An important point to note is that preservative effectiveness has to be demonstrated in the final formulation containing the active drug and all excipient components.

Some preservatives can cause injection site reactions, which is another factor that needs consideration when choosing a preservative. In clinical trials that focused on the evaluation of preservatives and buffers in Norditropin, pain perception was observed to be lower in formulations containing phenol and benzyl alcohol as compared to a formulation containing m-cresol (Kappelgaard A. M., *Horm Res.* 62 Suppl 3:98-103 (2004)). Interestingly, among the commonly used preservative, benzyl alcohol possesses anesthetic properties (Minogue S C, and Sun D A., *Anesth Analg.*, 100(3): 683-6 (2005)).

Given the teachings and guidance provided herein, those skilled in the art will know what amount or range of excipient can be included in any particular formulation to achieve a biopharmaceutical formulation of the invention that promotes retention in stability of the biopharmaceutical. For example, the amount and type of a salt to be included in a biopharmaceutical formulation of the invention can be selected based on to the desired osmolality (i.e., isotonic, hypotonic or hypertonic) of the final solution as well as the amounts and osmolality of other components to be included in the formulation. Similarly, by exemplification with reference to the type of polyol or sugar included in a formulation, the amount of such an excipient will depend on its osmolality.

By way of example, inclusion of about 5% sorbitol can achieve isotonicity while about 9% of a sucrose excipient is needed to achieve isotonicity. Selection of the amount or range of concentrations of one or more excipients that can be included within a biopharmaceutical formulation of the invention has been exemplified above by reference to salts, polyols and sugars. However, those skilled in the art will understand that the considerations described herein and further exemplified by reference to specific excipients are equally applicable to all types and combinations of excipients including, for example, salts, amino acids, other tonicity agents, surfactants, stabilizers, bulking agents, cryoprotectants, lyoprotectants, anti-oxidants, metal ions, chelating agents and/or preservatives.

Further, where a particular excipient is reported in a formulation by, e.g., percent (%) w/v, those skilled in the art will recognize that the equivalent molar concentration of that excipient is also contemplated.

Of course, a person having ordinary skill in the art would recognize that the concentrations of the aforementioned excipients share an interdependency within a particular formulation. By way of example, the concentration of a bulking agent may be lowered where, e.g., there is a high protein/peptide concentration or where, e.g., there is a high stabilizing agent concentration. In addition, a person having ordinary skill in the art would recognize that, in order to maintain the isotonicity of a particular formulation in which there is no bulking agent, the concentration of a stabilizing agent would be adjusted accordingly (i.e., a "tonicifying" amount of stabilizer would be used).

The compositions are stable for at least two years at 2° C. to 8° C. in the lyophilized state. This long-term stability is beneficial for extending the shelf life of the pharmaceutical product.

Methods of Preparation

The present invention further contemplates methods for the preparation of therapeutic protein formulations. In one aspect, methods for preparing a lyophilized therapeutic peptibody formulation comprising the step of lyophilizing a therapeutic peptibody composition in a buffer comprising a buffering agent, a bulking agent, a stabilizing agent and a surfactant;

The present methods further comprise one or more of the following steps: adding a stabilizing agent to said mixture prior to lyophilizing, adding at least one agent selected from a bulking agent, an osmolarity regulating agent, and a surfactant to said mixture prior to lyophilization. The bulking agent may be any bulking agent described herein. In one aspect, the bulking agent is mannitol. In another embodiment, the stabilizing agent is sucrose. The surfactant may be any surfactant described herein. In one embodiment, the surfactant is polysorbate-20.

The standard reconstitution practice for lyophilized material is to add back a volume of pure water or sterile water for injection (WFI) (typically equivalent to the volume removed during lyophilization), although dilute solutions of antibacterial agents are sometimes used in the production of pharmaceuticals for parenteral administration [Chen, Drug Development and Industrial Pharmacy, 18:1311-1354 (1992)]. Accordingly, methods are provided for preparation of reconstituted therapeutic peptibodies comprising the step of adding a diluent to a lyophilized therapeutic peptibody composition of the invention.

The lyophilized therapeutic peptibody composition may be reconstituted as an aqueous solution. A variety of aqueous carriers, e.g., sterile water for injection, water with preservatives for multi dose use, or water with appropriate amounts of surfactants (for example, polysorbate-20), 0.4% saline, 0.3% glycine, or aqueous suspensions may contain the active compound in admixture with excipients suitable for the manufacture of aqueous suspensions. In various aspects, such excipients are suspending agents, for example sodium carboxymethylcellulose, methylcellulose, hydroxypropylmethylcellulose, sodium alginate, polyvinylpyrrolidone, gum tragacanth and gum acacia; dispersing or wetting agents may be a naturally-occurring phosphatide, for example lecithin, or condensation products of an alkylene oxide with fatty acids, for example polyoxyethylene stearate, or condensation products of ethylene oxide with long chain aliphatic alcohols, for example heptadecaethyl-eneoxycetanol, or condensation products of ethylene oxide with partial esters derived from fatty acids and a hexitol such as polyoxyethylene sorbitol monooleate, or condensation products of ethylene oxide with partial esters derived from fatty acids and hexitol anhydrides, for example polyethylene sorbitan monooleate. The aqueous suspensions may also contain one or more preservatives, for example ethyl, or n-propyl, p-hydroxybenzoate.

To administer compositions to human or test animals, in one aspect, the compositions comprises one or more pharmaceutically acceptable carriers. The phrases "pharmaceutically" or "pharmacologically acceptable" refer to molecular entities and compositions that are stable, inhibit protein degradation such as aggregation and cleavage products, and in addition do not produce allergic, or other adverse reactions when administered using routes well-known in the art, as described below. "Pharmaceutically acceptable carriers" include any and all clinically useful solvents, dispersion media, coatings, antibacterial and antifungal agents, isotonic and absorption delaying agents and the like, including those agents disclosed above.

The therapeutic peptibody compositions may be administered orally, topically, transdermally, parenterally, by inhalation spray, vaginally, rectally, or by intracranial injection. The term parenteral as used herein includes subcutaneous injections, intravenous, intramuscular, intracistemal injection, or infusion techniques. Administration by intravenous, intradermal, intramusclar, intramammary, intraperitoneal, intrathecal, retrobulbar, intrapulmonary injection and or surgical implantation at a particular site is contemplated as well. Generally, compositions are essentially free of pyrogens, as well as other impurities that could be harmful to the recipient.

Single or multiple administrations of the compositions can be carried out with the dose levels and pattern being selected by the treating physician. For the prevention or treatment of disease, the appropriate dosage will depend on the type of disease to be treated, as defined above, the severity and course of the disease, whether drug is administered for preventive or therapeutic purposes, previous therapy, the patient's clinical history and response to the drug, and the discretion of the attending physician.

Kits

As an additional aspect, the invention includes kits which comprise one or more lyophilized compounds or compositions packaged in a manner which facilitates their use for administration to subjects. In one embodiment, such a kit includes a compound or composition described herein (e.g., a composition comprising a therapeutic protein or peptide), packaged in a container such as a sealed bottle or vessel, with a label affixed to the container or included in the package that describes use of the compound or composition in practicing the method. In one embodiment, the kit contains a first container having a lyophilized therapeutic protein or peptide composition and a second container having a physiologically acceptable reconstitution solution for the lyophilized composition. In one aspect, the compound or composition is packaged in a unit dosage form. The kit may further include a device suitable for administering the composition according to a specific route of administration. Preferably, the kit contains a label that describes use of the therapeutic protein or peptide composition.

Dosages

The dosage regimen involved in a method for treating a condition described herein will be determined by the attending physician, considering various factors which modify the action of drugs, e.g. the age, condition, body weight, sex and diet of the patient, the severity of any infection, time of administration and other clinical factors. In various aspects, the daily regimen is in the range of 0.1-1000 µg of a preparation per kilogram of body weight (calculating the mass of the protein alone, without chemical modification) or 0.1-150 µg/kg. In some embodiments of the invention, the dose may exceed 1 mg/kg, 3 mg/kg, or 10 mg/kg.

Preparations of the invention may be administered by an initial bolus followed by a continuous infusion to maintain therapeutic circulating levels of drug product. As another example, the inventive compound may be administered as a one-time dose. Those of ordinary skill in the art will readily optimize effective dosages and administration regimens as determined by good medical practice and the clinical condition of the individual patient. The frequency of dosing will depend on the pharmacokinetic parameters of the agents and the route of administration. The optimal pharmaceutical formulation will be determined by one skilled in the art depending upon the route of administration and desired dosage. See for example, Remington's Pharmaceutical Sciences, 18th Ed. (1990, Mack Publishing Co., Easton, Pa. 18042) pages 1435-1712, the disclosure of which is hereby incorporated by reference. Such formulations may influence the physical state, stability, rate of in vivo release, and rate of in vivo clearance of the administered agents. Depending on the route of administration, a suitable dose may be calculated according to body weight, body surface area or organ size. Further refinement of the calculations necessary to determine the appropriate dosage for treatment involving each of the above mentioned formulations is routinely made by those of ordinary skill in the art without undue experimentation, especially in light of the dosage information and assays disclosed herein, as well as the pharmacokinetic data observed in the human clinical trials discussed above. Appropriate dosages may be ascertained through use of established assays for determining blood level dosages in conjunction with appropriate dose-response data. The final dosage regimen will be determined by the attending physician, considering various factors which modify the action of drugs, e.g. the drug's specific activity, the severity of the damage and the responsiveness of the patient, the age, condition, body weight, sex and diet of the patient, the severity of any infection, time of administration and other clinical factors. As studies are conducted, further information will emerge regarding the appropriate dosage levels and duration of treatment for various diseases and conditions.

Structure of Compounds

In General.

In preparations in accordance with the invention, a peptide is attached to a vehicle through the N-terminus of the peptide, C-terminus of the peptide, or both, and the resulting structure may be further modified with a covalently attached WSP which is attached to the vehicle moiety in the vehicle-peptide product. Thus, the therapeutic peptibody molecules of this invention may be described by the following formula I:

$$[(X^1)_a - F^1 - (X^2)_b] - (L^1)_c - WSP_d \qquad I$$

wherein:

$F^1$ is a vehicle;

$X^1$ is selected from $P^1 - (L^2)_e -$ $P^2 - (L^3)_f - P^1 - (L^2)_e -$ $P^3 - (L^4)_g - P^2 - (L^3)_f - P^1 - (L^2)_e -$ and $P^4 - (L^1)_h - P^3 - (L^4)_g - P^2 - (L^3) - P^1 - (L^2)_e -$ $X^2$ is selected from:

$-(L^2)_e - P^1,$ $-(L^2)_e - P^1 - (L^3)_f - P^2,$ $-(L^2)_e - P^1 - (L^3)_f - P^2 - (L^4)_g - P^3,$ and $-(L^2)_e - P^1 - (L^3)_f - P^2 - (L^4)_g - P^3 - (L^5)_h - P^4$ wherein $P^1$, $P^2$, $P^3$, and $P^4$ are each independent sequences of pharmacologically active peptides;

$L^1$, $L^2$, $L^3$, $L^4$, and $L^5$ are each independently linkers;

a, b, c, e, f, g, and h are each independently 0 or 1, provided that at least one of a and b is 1;

d is 0, 1, or greater than 1; and

WSP is a water soluble polymer, the attachment of which is effected at any reactive moiety in $F^1$.

Thus, compound I comprises compounds of the formulae $$[X^1 - F^1] - (L^1)_c - WSP_d \qquad II$$

including multimers thereof, wherein $F^1$ is an Fc domain and is attached at the C-terminus of $X^1$, and one or more WSP is attached to the Fc domain, optionally through linker $L^1$;

$$[F^1 - X^2] - (L^1)_c - WSP_d \qquad III$$

including multimers thereof, wherein $F^1$ is an Fc domain and is attached at the N-terminus of $X^2$, and one or more WSP is attached to the Fc domain, optionally through linker $L^1$;

$$[F^1 - (L^1)_e - P^1] - (L^1)_c - WSP_d \qquad IV$$

including multimers thereof, wherein $F^1$ is an Fc domain and is attached at the N-terminus of $-(L^1)_c - P^1$ and one or more WSP is attached to the Fc domain, optionally through linker $L^1$; and $$[F^1 - (L^1)_e - P^1 - (L^2)_f - P^2] - (L^1)_c - WSP_d \qquad V$$

including multimers thereof, wherein $F^1$ is an Fc domain and is attached at the N-terminus of -$L^1$-$P^1$-$L^2$-$P^2$ and one or more WSP is attached to the Fc domain, optionally through linker $L^1$.

In one embodiment, $F^1$ is an Fc domain and is attached to either the N-terminus or C-terminus of a peptide. In a related embodiment, the Fc is linked into a dimeric form as described herein to which 2 (or more) peptides are attached. The peptides may be homodimeric (i.e., the same amino acid sequence), or heterodynammic (i.e., different amino acid sequences that bind the same target or that bind different targets).

In another embodiment, Fc-Loops comprising a peptide(s) are provided. Fc-Loops comprising a peptide(s) are prepared in a process in which at least one biologically active peptide is incorporated as an internal sequence into an Fc domain. Such an internal sequence may be added by insertion (i.e., between amino acids in the previously existing Fc domain) or by replacement of amino acids in the previously existing Fc domain (i.e., removing amino acids in the previously existing Fc domain and adding peptide amino acids). In the latter case, the number of peptide amino acids added need not correspond to the number of amino acids removed from the previously existing Fc domain. For example, in one aspect, a molecule in which 10 amino acids are removed and 15 amino acids are added is provided. Pharmacologically active compounds provided are prepared by a process comprising: a) selecting at least one peptide that modulates the activity of a protein of interest; and b) preparing a pharmacologic agent comprising an amino acid sequence of the selected peptide as an internal sequence of an Fc domain. This process may be employed to modify an Fc domain that is already linked through an N- or C-terminus or sidechain to a peptide, e.g., as described in U.S. Pat. App. Nos. 2003/0195156, 2003/0176352, 2003/0229023, and 2003/0236193, and international publication numbers WO 00/24770 and WO 04/026329. The process described in U.S. Patent Application Publication No. US2006/0140934 may also be employed to modify an Fc domain that is part of an antibody. In this way, different molecules can be produced that have additional functionalities, such as a binding domain to a different epitope or an additional binding domain to the precursor molecule's existing epitope. Molecules comprising an internal peptide sequence are also referred to as "Fc internal peptibodies" or "Fc internal peptide molecules."

The Fc internal peptide molecules may include more than one peptide sequence in tandem in a particular internal region, and they may include further peptides in other internal regions. While the putative loop regions are preferred, insertions in any other non-terminal domains of the Fc are also considered part of this invention. Variants and derivatives of the above compounds (described below) are also encompassed by this invention.

The compounds of this invention may be prepared by standard synthetic methods, recombinant DNA techniques, or any other methods of preparing peptides and fusion proteins.

A use contemplated for Fc internal peptide molecules is as a therapeutic or a prophylactic agent. A selected peptide may have activity comparable to—or even greater than—the natural ligand mimicked by the peptide. In addition, certain natural ligand-based therapeutic agents might induce antibodies against the patient's own endogenous ligand. In contrast, the unique sequence of the vehicle-linked peptide avoids this pitfall by having little or typically no sequence identity with the natural ligand. Furthermore, the Fc internal peptibodies may have advantages in refolding and purification over N- or C-terminally linked Fc molecules. Further still, Fc internal peptibodies may be more stable in both thermodynamically, due to the stabilization of chimeric domains, and chemically, due to increased resistance to proteolytic degradation from amino- and carboxy-peptidases. Fc internal peptibodies may also exhibit improved pharmacokinetic properties.

Peptides.

Any number of peptides may be used in conjunction with the present invention. Of particular interest are peptides that mimic the activity of EPO, TPO, growth hormone, G-CSF, GM-CSF, IL-1ra, CTLA4, TRAIL, TNF, VEGF, MMP, myostatin, integrin, OPG, OPG-L, NGF, TALL-1, Ang-2 binding partner(s), TGF-α, and TGF-β. Peptide antagonists are also of interest, particularly those antagonistic to the activity of TNF, any of the interleukins (IL-1, 2, 3, . . . ), and proteins involved in complement activation (e.g., C3b). Targeting peptides are also of interest, including tumor-homing peptides, membrane-transporting peptides, and the like. All of these classes of peptides may be discovered by methods described in the references cited in this specification and other references.

Phage display, in particular, is useful in generating peptides for use in the present invention. It has been stated that affinity selection from libraries of random peptides can be used to identify peptide ligands for any site of any gene product. Dedman et al. (1993), J. Biol. Chem. 268: 23025-30. Phage display is particularly well suited for identifying peptides that bind to such proteins of interest as cell surface receptors or any proteins having linear epitopes. Wilson et al. (1998), Can. J. Microbiol. 44: 313-29; Kay et al. (1998), Drug Disc. Today 3: 370-8. Such proteins are extensively reviewed in Herz et al. (1997), J. Receptor & Signal Transduction Res. 17(5): 671-776, which is hereby incorporated by reference. Such proteins of interest are preferred for use in this invention.

By way of example and without limitation, a group of peptides that bind to cytokine receptors are provided. Cytokines have recently been classified according to their receptor code. See Inglot (1997), Archivum Immunologiae et Therapiae Experimentalis 45: 353-7, which is hereby incorporated by reference. Among these receptors are the CKRs (family I in Table 3). The receptor classification appears in Table 3.

TABLE 3

| Cytokine Receptors Classified by Receptor Code | | | |
|---|---|---|---|
| Cytokines (ligands) | | Receptor Type | |
| family | subfamily | family | subfamily |
| I. Hematopoietic cytokines | 1. IL-2, IL-4, IL-7, IL-9, IL-13, IL-15 | I. Cytokine R (CKR) | 1. shared γCr, IL-9R, IL-4R |
| | 2. IL-3, IL-5, GM-CSF | | 2. shared GP 140 βR |
| | 3. IL-6, IL-11, IL-12, LIF, OSM, | | 3. 3. shared RP 130, IL-6 R, Leptin R |

TABLE 3-continued

Cytokine Receptors Classified by Receptor Code

| Cytokines (ligands) | | Receptor Type | |
|---|---|---|---|
| family | subfamily | family | subfamily |
| | CNTF, Leptin (OB) | | 4. "single chain" R, GCSF-R, TPO-R, GH-R |
| | 4. G-CSF, EPO, TPO, PRL, GH | | |
| | 5. IL-17, HVS-IL-17 | | 5. other R[2] |
| II. IL-10 ligands | IL-10, BCRF-1, HSV-IL-10 | II. IL-10 R | |
| III. Interferons | 1. IFN-α1, α2, α4, m, t, IFN-β[3] | III. Interferon R | 1. IFNAR |
| | 2. IFN-γ | | 2. IFNGR |
| IV. IL-1 and IL-1 like ligands | 1. IL-1α, IL-1β, IL-1Ra | IV. IL-1R | 1. IL-1R, IL-1RAcP |
| | 2. IL-18, IL-18BP | | 2. IL-18R, IL-18RAcP |
| V. TNF family | 1. TNF-α, TNF-β (LT), FASL, CD40 L, CD30L, CD27 L, OX40L, OPGL, TRAIL, APRIL, AGP-3, BLys, TL5, Ntn-2, KAY, Neutrokine-α | 3. NGF/TNF R[4] | TNF-RI, AGP-3R, DR4, DR5, OX40, OPG, TACI, CD40, FAS, ODR |
| VI. Chemokines | 1. α chemokines: IL-8, GRO α, β, γ, IF-10, PF-4, SDF-1 | 4. Chemokine R | 1. CXCR |
| | | | 2. CCR |
| | | | 3. CR |
| | 2. β chemokines: MIP1α, MIP1β, MCP-1,2,3,4, RANTES, eotaxin | | 4. DARC[5] |
| | 3. γ chemokines: lymphotactin | | |
| VII. Growth factors | 1.1 SCF, M-CSF, PDGF-AA, AB, BB, KDR, FLT-1, FLT-3L, VEGF, SSV-PDGF, HGF, SF | VII. RKF | 1. TK sub-family |
| | | | 1.1 IgTK III R, VEGF-RI, VEGF-RII |
| | | | 1.2 IgTK IV R |
| | 1.2 FGFα, FGFβ | | 1.3 Cysteine-rich TK-I |
| | 1.3 EGF, TGF-α, VV-F19 (EGF-like) | | 1.4 Cysteine rich TK-II, IGF-RI |
| | 1.4 IGF-I, IGF-II, Insulin | | 1.5 Cysteine knot TK V |
| | 1.5 NGF, BDNF, NT-3, NT-4[6] | | 2. Serine-threonine kinase subfamily (STKS)[7] |
| | 2. TGF-β1, β2, β3 | | |

[1] IL-17R - belongs to CKR family but is unassigned to 4 indicated subjamilies.

[2] Other IFN type I subtypes remain unassigned. Hematopoietic cytokines, IL-10 ligands and interferons do not possess functional intrinsic protein kinases. The signaling molecules for the cytokines are JAK's, STATs and related non-receptor molecules. IL-14, IL-16 and IL-18 have been cloned but according to the receptor code they remain unassigned.

[3] TNF receptors use multiple, distinct intracellular molecules for signal transduction including "death domain" of FAS R and 55 kDa TNF-☐R that participates in their cytotoxic effects. NGF/TNF R can bind both NGF and related factors as well as TNF ligands. Chemokine receptors are seven transmembrane (7TM, serpentine) domain receptors. They are G protein-coupled.

[4] The Duffy blood group antigen (DARC) is an erythrocyte receptor that can bind several different chemokines. IL-1R belongs to the immunoglobulin superfamily but their signal transduction events characteristics remain unclear.

[5] The neurotrophic cytokines can associate with NGF/TNF receptors also.

[6] STKS may encompass many other TGF-β-related factors that remain unassigned. The protein kinases are intrinsic part of the intracellular domain of receptor kinase family (RKF). The enzymes participate in the signals transmission via the receptors.

Other proteins of interest as targets for peptide generation in the present invention include the following:

αvβ3
αVβ1
Ang-2
B7
B7RP1
CRP1
Calcitonin
CD28
CETP
cMet
Complement factor B
C4b
CTLA4
Glucagon
Glucagon Receptor
LIPG
MPL
splice variants of molecules preferentially expressed on tumor cells; e.g., CD44, CD30 unglycosylated variants of mucin and Lewis Y surface glycoproteins CD19, CD20, CD33, CD45
prostate specific membrane antigen and prostate specific cell antigen matrix metalloproteinases (MMPs), both secreted and membrane-bound (e.g., MMP-9)
Cathepsins
TIE-2 receptor
heparanase
urokinase plasminogen activator (UPA), UPA receptor
parathyroid hormone (PTH), parathyroid hormone-related protein (PTHrP), PTH-RI, PTH-RII
Her2
Her3
Insulin
Myostatin
TALL-1
Nerve growth factor
Integrins and receptors
Selectins and receptors thereof.
Cell adhesion molecules and receptors thereof.

Exemplary peptides appear in Tables 4 through 38 below. These peptides may be prepared by any methods disclosed in the art, many of which are discussed herein. In most tables that follow, single letter amino acid abbreviations are used. The "X" in these sequences (and throughout this specification, unless specified otherwise in a particular instance) means that any of the 20 naturally occurring amino acid residues may be present. Any of these peptides may be linked in tandem (i.e., sequentially), with or without linkers, and a few tandem-linked examples are provided in the table. Linkers are listed as "A" and may be any of the linkers described herein. Tandem repeats and linkers are shown separated by dashes for clarity. Any peptide containing a cysteinyl residue may be cross-linked with another Cys-containing peptide, either or both of which may be linked to a vehicle. A few cross-linked examples are provided in the table. Any peptide having more than one Cys residue may form an intrapeptide disulfide bond, as well; see, for example, EPO-mimetic peptides in Table 5. A few examples of intrapeptide disulfide-bonded peptides are specified in the table. Any of these peptides may be derivatized as described herein, and a few derivatized examples are provided in the table. Derivatized peptides in the tables are exemplary rather than limiting, as the associated underivatized peptides may be employed in this invention, as well. For derivatives in which the carboxyl terminus may be capped with an amino group, the capping amino group is shown as —NH$_2$. For derivatives in which amino acid residues are substituted by moieties other than amino acid residues, the substitutions are denoted by σ, which signifies any of the moieties described in Bhatnagar et al. (1996), J. Med. Chem. 39: 3814-9 and Cuthbertson et al. (1997), J. Med. Chem. 40: 2876-82, which are incorporated by reference. The J substituent and the Z substituents ($Z_5$, $Z_6$, ... $Z_{40}$) are as defined in U.S. Pat. Nos. 5,608,035, 5,786,331, and 5,880,096, which are incorporated by reference. For the EPO-mimetic sequences (Table 5), the substituents $X_2$ through $X_{11}$ and the integer "n" are as defined in WO 96/40772, which is incorporated by reference. Also for the EPO-mimetic sequences, the substituents $X_{na}$, $X_{1a}$, $X_{2a}$, $X_{3a}$, $X_{4a}$, $X_{5a}$ and $X_{ca}$ follow the definitions of $X_n$, $X_1$, $X_2$, $X_3$, $X_4$, $X_5$, and $X_c$, respectively, of WO 99/47151, which is also incorporated by reference. The substituents "Ψ" "Θ" and "+" are as defined in Sparks et al. (1996), Proc. Natl. Acad. Sci. 93: 1540-4, which is hereby incorporated by reference. $X_4$, $X_5$, $X_6$, and $X_7$ are as defined in U.S. Pat. No. 5,773,569, which is hereby incorporated by reference, except that: for integrin-binding peptides, $X_1$, $X_2$, $X_3$, $X_4$, $X_5$, $X_6$, $X_7$, and $X_8$ are as defined in International applications WO 95/14714, published Jun. 1, 1995 and WO 97/08203, published Mar. 6, 1997, which are also incorporated by reference; and for VIP-mimetic peptides, $X_1$, $X_1'$, $X_1''$, $X_2$, $X_3$, $X_4$, $X_5$, $X_6$ and Z and the integers m and n are as defined in WO 97/40070, published Oct. 30, 1997, which is also incorporated by reference. Xaa and Yaa below are as defined in WO 98/09985, published Mar. 12, 1998, which is incorporated by reference. $AA_1$, $AA_2$, $AB_1$, $AB_2$, and AC are as defined in International application WO 98/53842, published Dec. 3, 1998, which is incorporated by reference. $X^1$, $X^2$, $X^3$, and $X^4$ in Table 17 only are as defined in European application EP 0 911 393, published Apr. 28, 1999. Residues appearing in boldface are D-amino acids. All peptides are linked through peptide bonds unless otherwise noted. Abbreviations are listed at the end of this specification. In the "SEQ ID NO." column, "NR" means that no sequence listing is required for the given sequence.

TABLE 4

IL-1 antagonist peptide sequences

| Sequence/structure | SEQ ID NO: |
|---|---|
| $Z_{11}Z_7Z_8QZ_5YZ_6Z_9Z_{10}$ | 3 |
| $XXQZ_5YZ_6XX$ | 4 |
| $Z_7XQZ_5YZ_6XX$ | 5 |
| $Z_7Z_8QZ_5YZ_6Z_9Z_{10}$ | 6 |
| $Z_{11}Z_7Z_8QZ_5YZ_6Z_9Z_{10}$ | 7 |
| $Z_{12}Z_{13}Z_{14}Z_{15}Z_{16}Z_{17}Z_{18}Z_{19}Z_{20}Z_{21}Z_{22}Z_{11}Z_7Z_8QZ_5YZ_6Z_9Z_{10}L$ | 8 |
| $Z_{23}NZ_{24}Z_{39}Z_{25}Z_{26}Z_{27}Z_{28}Z_{29}Z_{30}Z_{40}$ | 9 |
| TANVSSFEWTPYYWQPYALPL | 10 |
| SWTDYGYWQPYALPISGL | 11 |
| ETPFTWEESNAYYWQPYALPL | 12 |
| ENTYSPNWADSMYWQPYALPL | 13 |
| SVGEDHNFWTSEYWQPYALPL | 14 |

TABLE 4-continued

IL-1 antagonist peptide sequences

| Sequence/structure | SEQ ID NO: |
| --- | --- |
| DGYDRWRQSGERYWQPYALPL | 15 |
| FEWTPGYWQPY | 16 |
| FEWTPGYWQHY | 17 |
| FEWTPGWYQJY | 18 |
| AcFEWTPGWYQJY | 19 |
| FEWTPGWpYQJY | 20 |
| FAWTPGYWQJY | 21 |
| FEWAPGYWQJY | 22 |
| FEWVPGYWQJY | 23 |
| FEWTPGYWQJY | 24 |
| AcFEWTPGYWQJY | 25 |
| FEWTPaWYQJY | 26 |
| FEWTPSarWYQJY | 27 |
| FEWTPGYYQPY | 28 |
| FEWTPGWWQPY | 29 |
| FEWTPNYWQPY | 30 |
| FEWTPvYWQJY | 31 |
| FEWTPecGYWQJY | 32 |
| FEWTPAibYWQJY | 33 |
| FEWTSarGYWQJY | 34 |
| FEWTPGYWQPY | 35 |
| FEWTPGYWQHY | 36 |
| FEWTPGWYQJY | 37 |
| AcFEWTPGWYQJY | 38 |
| FEWTPGW-pY-QJY | 39 |
| FAWTPGYWQJY | 40 |
| FEWAPGYWQJY | 41 |
| FEWVPGYWQJY | 42 |
| FEWTPGYWQJY | 43 |
| AcFEWTPGYWQJY | 44 |
| FEWTPAWYQJY | 45 |
| FEWTPSarWYQJY | 46 |
| FEWTPGYYQPY | 47 |
| FEWTPGWWQPY | 48 |
| FEWTPNYWQPY | 49 |
| FEWTPVYWQJY | 50 |
| FEWTPecGYWQJY | 51 |
| FEWTPAibYWQJY | 52 |
| FEWTSarGYWQJY | 53 |
| FEWTPGYWQPYALPL | 54 |
| 1NapEWTPGYYQJY | 55 |
| YEWTPGYYQJY | 56 |
| FEWVPGYYQJY | 57 |
| FEWTPSYYQJY | 58 |
| FEWTPNYYQJY | 59 |
| TKPR | 60 |
| RKSSK | 61 |
| RKQDK | 62 |
| NRKQDK | 63 |
| RKQDKR | 64 |
| ENRKQDKRF | 65 |
| VTKFYF | 66 |
| VTKFY | 67 |
| VTDFY | 68 |
| SHLYWQPYSVQ | 69 |
| TLVYWQPYSLQT | 70 |
| RGDYWQPYSVQS | 71 |
| VHVYWQPYSVQT | 72 |
| RLVYWQPYSVQT | 73 |
| SRVWFQPYSLQS | 74 |
| NMVYWQPYSIQT | 75 |
| SVVFWQPYSVQT | 76 |
| TFVYWQPYALPL | 77 |
| TLVYWQPYSIQR | 78 |
| RLVYWQPYSVQR | 79 |
| SPVFWQPYSIQI | 80 |
| WIEWWQPYSVQS | 81 |
| SLIYWQPYSLQM | 82 |
| TRLYWQPYSVQR | 83 |
| RCDYWQPYSVQT | 84 |
| MRVFWQPYSVQN | 85 |
| KIVYWQPYSVQT | 86 |
| RHLYWQPYSVQR | 87 |
| ALVWWQPYSEQI | 88 |

TABLE 4-continued

IL-1 antagonist peptide sequences

| Sequence/structure | SEQ ID NO: |
|---|---|
| SRVWFQPYSLQS | 89 |
| WEQPYALPLE | 90 |
| QLVWWQPYSVQR | 91 |
| DLRYWQPYSVQV | 92 |
| ELVWWQPYSLQL | 93 |
| DLVWWQPYSVQW | 94 |
| NGNYWQPYSFQV | 95 |
| ELVYWQPYSIQR | 96 |
| ELMYWQPYSVQE | 97 |
| NLLYWQPYSMQD | 98 |
| GYEWYQPYSVQR | 99 |
| SRVWYQPYSVQR | 100 |
| LSEQYQPYSVQR | 101 |
| GGGWWQPYSVQR | 102 |
| VGRWYQPYSVQR | 103 |
| VHVYWQPYSVQR | 104 |
| QARWYQPYSVQR | 105 |
| VHVYWQPYSVQT | 106 |
| RSVYWQPYSVQR | 107 |
| TRVWFQPYSVQR | 108 |
| GRIWFQPYSVQR | 109 |
| GRVWFQPYSVQR | 110 |
| ARTWYQPYSVQR | 111 |
| ARVWWQPYSVQM | 112 |
| RLMFYQPYSVQR | 113 |
| ESMWYQPYSVQR | 114 |
| HFGWWQPYSVHM | 115 |
| ARFWWQPYSVQR | 116 |
| RLVYWQ PYAPIY | 117 |
| RLVYWQ PYSYQT | 118 |
| RLVYWQ PYSLPI | 119 |
| RLVYWQ PYSVQA | 120 |
| SRVWYQ PYAKGL | 121 |
| SRVWYQ PYAQGL | 122 |
| SRVWYQ PYAMPL | 123 |
| SRVWYQ PYSVQA | 124 |
| SRVWYQ PYSLGL | 125 |

TABLE 4-continued

IL-1 antagonist peptide sequences

| Sequence/structure | SEQ ID NO: |
|---|---|
| SRVWYQ PYAREL | 126 |
| SRVWYQ PYSRQP | 127 |
| SRVWYQ PYFVQP | 128 |
| EYEWYQ PYALPL | 129 |
| IPEYWQ PYALPL | 130 |
| SRIWWQ PYALPL | 131 |
| DPLFWQ PYALPL | 132 |
| SRQWVQ PYALPL | 133 |
| IRSWWQ PYALPL | 134 |
| RGYWQ PYALPL | 135 |
| RLLWVQ PYALPL | 136 |
| EYRWFQ PYALPL | 137 |
| DAYWVQ PYALPL | 138 |
| WSGYFQ PYALPL | 139 |
| NIEFWQ PYALPL | 140 |
| TRDWVQ PYALPL | 141 |
| DSSWYQ PYALPL | 142 |
| IGNWYQ PYALPL | 143 |
| NLRWDQ PYALPL | 144 |
| LPEFWQ PYALPL | 145 |
| DSYWWQ PYALPL | 146 |
| RSQYYQ PYALPL | 147 |
| ARFWLQ PYALPL | 148 |
| NSYFWQ PYALPL | 149 |
| RFMYWQPYSVQR | 150 |
| AHLFWQPYSVQR | 151 |
| WWQPYALPL | 152 |
| YYQPYALPL | 153 |
| YFQPYALGL | 154 |
| YWYQPYALPL | 155 |
| RWWQPYATPL | 156 |
| GWYQPYALGF | 157 |
| YWYQPYALGL | 158 |
| IWYQPYAMPL | 159 |
| SNMQPYQRLS | 160 |
| TFVYWQPY AVGLPAAETACN | 161 |
| TFVYWQPY SVQMTITGKVTM | 162 |

TABLE 4-continued

IL-1 antagonist peptide sequences

| Sequence/structure | SEQ ID NO: |
|---|---|
| TFVYWQPY SSHXXVPXGFPL | 163 |
| TFVYWQPY YGNPQWAIHVRH | 164 |
| TFVYWQPY VLLELPEGAVRA | 165 |
| TFVYWQPY VDYVWPIPIAQV | 166 |
| GWYQPYVDGWR | 167 |
| RWEQPYVKDGWS | 168 |
| EWYQPYALGWAR | 169 |
| GWWQPYARGL | 170 |
| LFEQPYAKALGL | 171 |
| GWEQPYARGLAG | 172 |
| AWVQPYATPLDE | 173 |
| MWYQPYSSQPAE | 174 |
| GWTQPYSQQGEV | 175 |
| DWFQPYSIQSDE | 176 |
| PWIQPYARGFG | 177 |
| RPLYWQPYSVQV | 178 |
| TLIYWQPYSVQI | 179 |
| RFDYWQPYSDQT | 180 |
| WHQFVQPYALPL | 181 |
| EWDS VYWQPYSVQ TLLR | 182 |
| WEQN VYWQPYSVQ SFAD | 183 |
| SDV VYWQPYSVQ SLEM | 184 |
| YYDG VYWQPYSVQ VMPA | 185 |
| SDIWYQ PYALPL | 186 |
| QRIWWQ PYALPL | 187 |
| SRIWWQ PYALPL | 188 |
| RSLYWQ PYALPL | 189 |
| TIIWEQ PYALPL | 190 |
| WETWYQ PYALPL | 191 |
| SYDWEQ PYALPL | 192 |
| SRIWCQ PYALPL | 193 |
| EIMFWQ PYALPL | 194 |
| DYVWQQ PYALPL | 195 |
| MDLLVQ WYQPYALPL | 196 |
| GSKVIL WYQPYALPL | 197 |
| RQGANI WYQPYALPL | 198 |
| GGGDEP WYQPYALPL | 199 |

TABLE 4-continued

IL-1 antagonist peptide sequences

| Sequence/structure | SEQ ID NO: |
|---|---|
| SQLERT WYQPYALPL | 200 |
| ETWVRE WYQPYALPL | 201 |
| KKGSTQ WYQPYALPL | 202 |
| LQARMN WYQPYALPL | 203 |
| EPRSQK WYQPYALPL | 204 |
| VKQKWR WYQPYALPL | 205 |
| LRRHDV WYQPYALPL | 206 |
| RSTASI WYQPYALPL | 207 |
| ESKEDQ WYQPYALPL | 208 |
| EGLTMK WYQPYALPL | 209 |
| EGSREG WYQPYALPL | 210 |
| VIEWWQ PYALPL | 211 |
| VWYWEQ PYALPL | 212 |
| ASEWWQ PYALPL | 213 |
| FYEWWQ PYALPL | 214 |
| EGWWVQ PYALPL | 215 |
| WGEWLQ PYALPL | 216 |
| DYVWEQ PYALPL | 217 |
| AHTWWQ PYALPL | 218 |
| FIEWFQ PYALPL | 219 |
| WLAWEQ PYALPL | 220 |
| VMEWWQ PYALPL | 221 |
| ERMWQ PYALPL | 222 |
| NXXWXX PYALPL | 223 |
| WGNWYQ PYALPL | 224 |
| TLYWEQ PYALPL | 225 |
| VWRWEQ PYALPL | 226 |
| LLWTQ PYALPL | 227 |
| SRIWXX PYALPL | 228 |
| SDIWYQ PYALPL | 229 |
| WGYYXX PYALPL | 230 |
| TSGWYQ PYALPL | 231 |
| VHPYXX PYALPL | 232 |
| EHSYFQ PYALPL | 233 |
| XXIWYQ PYALPL | 234 |
| AQLHSQ PYALPL | 235 |
| WANWFQ PYALPL | 236 |

TABLE 4-continued

IL-1 antagonist peptide sequences

| Sequence/structure | SEQ ID NO: |
|---|---|
| SRLYSQ PYALPL | 237 |
| GVTFSQ PYALPL | 238 |
| SIVWSQ PYALPL | 239 |
| SRDLVQ PYALPL | 240 |
| HWGH VYWQPYSVQ DDLG | 241 |
| SWHS VYWQPYSVQ SVPE | 242 |
| WRDS VYWQPYSVQ PESA | 243 |
| TWDA VYWQPYSVQ KWLD | 244 |
| TPPW VYWQPYSVQ SLDP | 245 |
| YWSS VYWQPYSVQ SVHS | 246 |
| YWY QPY ALGL | 247 |
| YWY QPY ALPL | 248 |
| EWI QPY ATGL | 249 |
| NWE QPY AKPL | 250 |
| AFY QPY ALPL | 251 |
| FLY QPY ALPL | 252 |
| VCK QPY LEWC | 253 |
| ETPFTWEESNAYYWQPYALPL | 254 |
| QGWLTWQDSVDMYWQPYALPL | 255 |
| FSEAGYTWPENTYWQPYALPL | 256 |
| TESPGGLDWAKIYWQPYALPL | 257 |
| DGYDRWRQSGERYWQPYALPL | 258 |
| TANVSSFEWTPGYWQPYALPL | 259 |
| SVGEDHNFWTSE YWQPYALPL | 260 |
| MNDQTSEVSTFP YWQPYALPL | 261 |
| SWSEAFEQPRNL YWQPYALPL | 262 |
| QYAEPSALNDWG YWQPYALPL | 263 |
| NGDWATADWSNY YWQPYALPL | 264 |
| THDEHI YWQPYALPL | 265 |
| MLEKTYTTWTPG YWQPYALPL | 266 |
| WSDPLTRDADL YWQPYALPL | 267 |
| SDAFTTQDSQAM YWQPYALPL | 268 |
| GDDAAWRTDSLT YWQPYALPL | 269 |
| AIIRQLYRWSEM YWQPYALPL | 270 |
| ENTYSPNWADSM YWQPYALPL | 271 |
| MNDQTSEVSTFP YWQPYALPL | 272 |
| SVGEDHNFWTSE YWQPYALPL | 273 |
| QTPFTWEESNAY YWQPYALPL | 274 |
| ENPFTWQESNAY YWQPYALPL | 275 |
| VTPFTWEDSNVF YWQPYALPL | 276 |
| QIPFTWEQSNAY YWQPYALPL | 277 |
| QAPLTWQESAAY YWQPYALPL | 278 |
| EPTFTWEESKAT YWQPYALPL | 279 |
| TTTLTWEESNAY YWQPYALPL | 280 |
| ESPLTWEESSAL YWQPYALPL | 281 |
| ETPLTWEESNAY YWQPYALPL | 282 |
| EATFTWAESNAY YWQPYALPL | 283 |
| EALFTWKESTAY YWQPYALPL | 284 |
| STP-TWEESNAY YWQPYALPL | 285 |
| ETPFTWEESNAY YWQPYALPL | 286 |
| KAPFTWEESQAY YWQPYALPL | 287 |
| STSFTWEESNAY YWQPYALPL | 288 |
| DSTFTWEESNAY YWQPYALPL | 289 |
| YIPFTWEESNAY YWQPYALPL | 290 |
| QTAFTWEESNAY YWQPYALPL | 291 |
| ETLFTWEESNAT YWQPYALPL | 292 |
| VSSFTWEESNAY YWQPYALPL | 293 |
| QPYALPL | 294 |
| Py-1-NapPYQJYALPL | 295 |
| TANVSSFEWTPG YWQPYALPL | 296 |
| FEWTPGYWQPYALPL | 297 |
| FEWTPGYWQJYALPL | 298 |
| FEWTPGYYQJYALPL | 299 |
| ETPFTWEESNAYYWQPYALPL | 300 |
| FTWEESNAYYWQJYALPL | 301 |
| ADVL YWQPYA PVTLWV | 302 |
| GDVAE YWQPYA LPLTSL | 303 |
| SWTDYG YWQPYA LPISGL | 304 |
| FEWTPGYWQPYALPL | 305 |
| FEWTPGYWQJYALPL | 306 |
| FEWTPGWYQPYALPL | 307 |
| FEWTPGWYQJYALPL | 308 |
| FEWTPGYYQPYALPL | 309 |
| FEWTPGYYQJYALPL | 310 |

TABLE 4-continued

IL-1 antagonist peptide sequences

| Sequence/structure | SEQ ID NO: |
|---|---|
| TANVSSFEWTPGYWQPYALPL | 311 |
| SWTDYGYWQPYALPISGL | 312 |
| ETPFTWEESNAYYWQPYALPL | 313 |
| ENTYSPNWADSMYWQPYALPL | 314 |
| SVGEDHNFWTSEYWQPYALPL | 315 |
| DGYDRWRQSGERYWQPYALPL | 316 |
| FEWTPGYWQPYALPL | 317 |
| FEWTPGYWQPY | 318 |
| FEWTPGYWQJY | 319 |
| EWTPGYWQPY | 320 |
| FEWTPGWYQJY | 321 |
| AEWTPGYWQJY | 322 |
| FAWTPGYWQJY | 323 |
| FEATPGYWQJY | 324 |
| FEWAPGYWQJY | 325 |
| FEWTAGYWQJY | 326 |
| FEWTPAYWQJY | 327 |
| FEWTPGAWQJY | 328 |
| FEWTPGYAQJY | 329 |
| FEWTPGYWQJA | 330 |
| FEWTGGYWQJY | 331 |
| FEWTPGYWQJY | 332 |
| FEWTJGYWQJY | 333 |
| FEWTPecGYWQJY | 334 |
| FEWTPAibYWQJY | 335 |
| FEWTPSarWYQJY | 336 |
| FEWTSarGYWQJY | 337 |
| FEWTPNYWQJY | 338 |
| FEWTPVYWQJY | 339 |
| FEWTVPYWQJY | 340 |
| AcFEWTPGWYQJY | 341 |
| AcFEWTPGYWQJY | 342 |
| 1Nap-EWTPGYYQJY | 343 |
| YEWTPGYYQJY | 344 |
| FEWVPGYYQJY | 345 |
| FEWTPGYYQJY | 346 |
| FEWTPsYYQJY | 347 |
| FEWTPnYYQJY | 348 |
| SHLY-Nap-QPYSVQM | 349 |
| TLVY-Nap-QPYSLQT | 350 |
| RGDY-Nap-QPYSVQS | 351 |
| NMVY-Nap-QPYSIQT | 352 |
| VYWQPYSVQ | 353 |
| VY-Nap-QPYSVQ | 354 |
| TFVYWQJYALPL | 355 |
| FEWTPGYYQJ-Bpa | 356 |
| XaaFEWTPGYYQJ-Bpa | 357 |
| FEWTPGY-Bpa-QJY | 358 |
| AcFEWTPGY-Bpa-QJY | 359 |
| FEWTPG-Bpa-YQJY | 360 |
| AcFEWTPG-Bpa-YQJY | 361 |
| AcFE-Bpa-TPGYYQJY | 362 |
| AcFE-Bpa-TPGYYQJY | 363 |
| Bpa-EWTPGYYQJY | 364 |
| AcBpa-EWTPGYYQJY | 365 |
| VYWQPYSVQ | 366 |
| RLVYWQPYSVQR | 367 |
| RLVY-Nap-QPYSVQR | 368 |
| RLDYWQPYSVQR | 369 |
| RLVWFQPYSVQR | 370 |
| RLVYWQPYSIQR | 371 |
| DNSSWYDSFLL | 372 |
| DNTAWYESFLA | 373 |
| DNTAWYENFLL | 374 |
| PARE DNTAWYDSFLI WC | 375 |
| TSEY DNTTWYEKFLA SQ | 376 |
| SQIP DNTAWYQSFLL HG | 377 |
| SPFI DNTAWYENFLL TY | 378 |
| EQIY DNTAWYDHFLL SY | 379 |
| TPFI DNTAWYENFLL TY | 380 |
| TYTY DNTAWYERFLM SY | 381 |
| TMTQ DNTAWYENFLL SY | 382 |
| TI DNTAWYANLVQ TYPQ | 383 |
| TI DNTAWYERFLA QYPD | 384 |

TABLE 4-continued

IL-1 antagonist peptide sequences

| Sequence/structure | SEQ ID NO: |
|---|---|
| HI DNTAWYENFLL TYTP | 385 |
| SQ DNTAWYENFLL SYKA | 386 |
| QI DNTAWYERFLL QYNA | 387 |
| NQ DNTAWYESFLL QYNT | 388 |
| TI DNTAWYENFLL NHNL | 389 |
| HY DNTAWYERFLQ QGWH | 390 |
| ETPFTWEESNAYYWQPYALPL | 391 |
| YIPFTWEESNAYYWQPYALPL | 392 |
| DGYDRWRQSGERYWQPYALPL | 393 |
| pY-1Nap-pY-QJYALPL | 394 |
| TANVSSFEWTPGYWQPYALPL | 395 |
| FEWTPGYWQJYALPL | 396 |
| FEWTPGYWQPYALPLSD | 397 |
| FEWTPGYYQJYALPL | 398 |
| FEWTPGYWQJY | 399 |
| AcFEWTPGYWQJY | 400 |
| AcFEWTPGWYQJY | 401 |
| AcFEWTPGYYQJY | 402 |
| AcFEWTPaYWQJY | 403 |
| AcFEWTPaWYQJY | 404 |
| AcFEWTPaYYQJY | 405 |
| FEWTPGYYQJYALPL | 406 |
| FEWTPGYWQJYALPL | 407 |
| FEWTPGWYQJYALPL | 408 |
| TANVSSFEWTPGYWQPYALPL | 409 |
| AcFEWTPGYWQJY | 410 |
| AcFEWTPGWYQJY | 411 |
| AcFEWTPGYYQJY | 412 |
| AcFEWTPAYWQJY | 413 |
| AcFEWTPAWYQJY | 414 |
| AcFEWTPAYYQJY | 415 |

TABLE 5

EPO-mimetic peptide sequences

| Sequence/structure | SEQ ID NO: |
|---|---|
| YXCXXGPXTWXCXP | 416 |
| YXCXXGPXTWXCXP-YXCXXGPXTWXCXP | 417 |
| YXCXXGPXTWXCXP-Λ-YXCXXGPXTWXCXP | 418 |
| YXCXXGPXTWXCXP-Λ-(ε-amine)\K/βA\YXCXXGPXTWXCXP-Λ-(α-amine) | 419 |
| GGTYSCHFGPLTWVCKPQGG | 420 |
| GGDYHCRMGPLTWVCKPLGG | 421 |
| GGVYACRMGPITWVCSPLGG | 422 |
| VGNYMCHFGPITWVGRPGGG | 423 |
| GGLYLCRFGPVTWDCGYKGG | 424 |
| GGTYSCHFGPLTWVCKPQGG-GGTYSCHFGPLTWVCKPQGG | 425 |
| GGTYSCHFGPLTWVCKPQGG-Λ-GGTYSCHFGPLTWVCKPQGG | 426 |
| GGTYSCHFGPLTWVCKPQGGSSK | 427 |
| GGTYSCHFGPLTWVCKPQGGSSK-GGTYSCHFGPLTWVCKPQGGSSK | 428 |
| GGTYSCHFGPLTWVCKPQGGSSK-Λ-GGTYSCHFGPLTWVCKPQGGSSK | 429 |
| GGTYSCHFGPLTWVCKPQGGSS\(ε-amine)\K/βA\GGTYSCHFGPLTWVCKPQGGSS/(α-amine) | 430 |
| GGTYSCHFGPLTWVCKPQGGSSK(Λ-biotin) | 431 |
| $CX_4X_5GPX_6TWX_7C$ | 432 |
| GGTYSCHGPLTWVCKPQGG | 433 |
| VGNYMAHMGPITWVCRPGG | 434 |
| GGPHHVYACRMGPLTWIC | 435 |
| GGTYSCHFGPLTWVCKPQ | 436 |
| GGLYACHMGPMTWVCQPLRG | 437 |
| TIAQYICYMGPETWECRPSPKA | 438 |
| YSCHFGPLTWVCK | 439 |
| YCHFGPLTWVC | 440 |
| $X_3X_4X_5GPX_6TWX_7X_8$ | 441 |
| $YX_2X_3X_4X_5GPX_6TWX_7X_8$ | 442 |
| $X_1YX_2X_3X_4X_5GPX_6TWX_7X_8X_9X_{10}X_{11}$ | 443 |
| $X_1YX_2CX_4X_5GPX_6TWX_7CX_9X_{10}X_{11}$ | 444 |
| GGLYLCRFGPVTWDCGYKGG | 445 |
| GGTYSCHFGPLTWVCKLPQGG | 446 |
| GGDYHCRMGPLTWVCKPLGG | 447 |
| VGNYMCHFGPITWVCRPGGG | 448 |
| GGVYACRMGPITWVCSPLGG | 449 |
| VGNYMAHMGPITWVCRPGG | 450 |
| GGTYSCHFGPLTWVCKPQ | 451 |
| GGLYACHMGPMTWVCQPLRG | 452 |
| TIAQYICYMGPETWECRPSPKA | 453 |
| YSCHFGPLTWVCK | 454 |
| YCHFGPLTWVC | 455 |
| SCHFGPLTWVCK | 456 |
| $(AX_2)_nX_3X_4X_5GPX_6TWX_7X_8$ | 457 |
| $X_nCX_1X_2GWVGX_3CX_4X_5WX_C$ | 458 |

TABLE 6

TPO-mimetic peptide sequences

| Sequence/structure | SEQ ID NO: |
|---|---|
| IEGPTLRQWLAARA | 459 |
| IEGPTLRQWLAAKA | 460 |
| IEGPTLREWLAARA | 461 |
| IEGPTLRQWLAARA-Λ-IEGPTLRQWLAARA | 462 |
| IEGPTLRQWLAAKA-Λ-IEGPTLRQWLAAKA | 463 |

TABLE 6-continued

TPO-mimetic peptide sequences

| Sequence/structure | SEQ ID NO: |
|---|---|
| IEGPTLRQCLAARA-Λ-IEGPTLRQCLAARA (bridged) | 464 |
| IEGPTLRQWLAARA-Λ-K(BrAc)-Λ-IEGPTLRQWLAARA | 465 |
| IEGPTLRQWLAARA-Λ-K(PEG)-Λ-IEGPTLRQWLAARA | 466 |
| IEGPTLRQCLAARA-Λ-IEGPTLRQWLAARA / IEGPTLRQCLAARA-Λ-IEGPTLRQWLAARA | 467 |
| IEGPTLRQWLAARA-Λ-IEGPTLRQCLAARA / IEGPTLRQWLAARA-Λ-IEGPTLRQCLAARA | 468 |
| VRDQIXXXL | 469 |
| TLREWL | 470 |
| GRVRDQVAGW | 471 |
| GRVKDQIAQL | 472 |
| GVRDQVSWAL | 473 |
| ESVREQVMKY | 474 |
| SVRSQISASL | 475 |
| GVRETVYRIHM | 476 |
| GVREVIVMHML | 477 |
| GRVRDQIWAAL | 478 |
| AGVRDQILIWL | 479 |
| GRVRDQIMLSL | 480 |
| GRVRDQI(X)$_3$L | 481 |
| CTLRQWLQGC | 482 |
| CTLQEFLEGC | 483 |
| CTRTEWLHGC | 484 |
| CTLREWLHGGFC | 485 |
| CTLREWVFAGLC | 486 |
| CTLRQWLILLGMC | 487 |
| CTLAEFLASGVEQC | 488 |
| CSLQEFLSHGGYVC | 489 |
| CTLREFLDPTTAVC | 490 |
| CTLKEWLVSHEVWC | 491 |
| CTLREWL(X)$_{2-6}$C | 492 |
| REGPTLRQWM | 493 |
| EGPTLRQWLA | 494 |
| ERGPFWAKAC | 495 |
| REGPRCVMWM | 496 |
| CGTEGPTLSTWLDC | 497 |
| CEQDGPTLLEWLKC | 498 |
| CELVGPSLMSWLTC | 499 |
| CLTGPFVTQWLYEC | 500 |
| CRAGPTLLEWLTLC | 501 |
| CADGPTLREWISFC | 502 |
| C(X)$_{1-2}$EGPTLREWL(X)$_{1-2}$C | 503 |
| GGCTLREWLHGGFCGG | 504 |
| GGCADGPTLREWISFCGG | 505 |
| GNADGPTLRQWLEGRRPKN | 506 |
| LAIEGPTLRQWLHGNGRDT | 507 |
| HGRVGPTLREWKTQVATKK | 508 |
| TIKGPTLRQWLKSREHTS | 509 |
| ISDGPTLKEWLSVTRGAS | 510 |
| SIEGPTLREWLTSRTPHS | 511 |

TABLE 7

G-CSF-mimetic peptide sequences

| Sequence/structure | SEQ ID NO: |
|---|---|
| EEDCK | 512 |
| EEDCK / EEDCK | 513 |
| EEDσK | 514 |
| EEDσK / EEDσK | 515 |
| pGluEDσK | 516 |
| pGluEDσK / pGluEDσK | 517 |
| PicSDσK | 518 |
| PicSDσK / PicSDσK | 519 |
| EEDCK-Λ-EEDCK | 520 |
| EEDXK-Λ-EEDXK | 521 |

TABLE 8

TNF-antagonist peptide sequences

| Sequence/structure | SEQ ID NO: |
|---|---|
| YCFTASENHCY | 522 |
| YCFTNSENHCY | 523 |
| YCFTRSENHCY | 524 |
| FCASENHCY | 525 |
| YCASENHCY | 526 |
| FCNSENHCY | 527 |
| FCNSENRCY | 528 |
| FCNSVENRCY | 529 |
| YCSQSVSNDCF | 530 |
| FCVSNDRCY | 531 |
| YCRKELGQVCY | 532 |
| YCKEPGQCY | 533 |
| YCRKEMGCY | 534 |
| FCRKEMGCY | 535 |
| YCWSQNLCY | 536 |
| YCELSQYLCY | 537 |
| YCWSQNYCY | 538 |
| YCWSQYLCY | 539 |
| DFLPHYKNTSLGHRP | 540 |
| AA$_1$-AB$_1$ \ AC / AA$_2$-AB$_2$ | NR |

TABLE 9

Integrin-binding peptide sequences

| Sequence/structure | SEQ ID NO: |
|---|---|
| RX$_1$ETX$_2$WX$_3$ | 541 |
| RX$_1$ETX$_2$WX$_3$ | 542 |
| RGDGX | 543 |
| CRGDGXC | 544 |
| CX$_1$X$_2$RLDX$_3$X$_4$C | 545 |
| CARRLDAPC | 546 |
| CPSRLDSPC | 547 |
| X$_1$X$_2$X$_3$RGDX$_4$X$_5$X$_6$ | 548 |
| CX$_2$CRGDCX$_5$C | 549 |
| CDCRGDCFC | 550 |
| CDCRGDCLC | 551 |
| CLCRGDCIC | 552 |
| X$_1$X$_2$DDX$_4$X$_5$X$_7$X$_8$ | 553 |
| X$_1$X$_2$X$_3$DDX$_4$X$_5$X$_6$X$_7$X$_8$ | 554 |
| CWDDGWLC | 555 |
| CWDDLWWLC | 556 |
| CWDDGLMC | 557 |
| CWDDGWMC | 558 |
| CSWDDGWLC | 559 |
| CPDDLWWLC | 560 |
| NGR | NR |
| GSL | NR |
| RGD | NR |
| CGRECPRLCQSSC | 561 |
| CNGRCVSGCAGRC | 562 |
| CLSGSLSC | 563 |
| RGD | NR |
| NGR | NR |
| GSL | NR |
| NGRAHA | 564 |
| CNGRC | 565 |
| CDCRGDCFC | 566 |
| CGSLVRC | 567 |
| DLXXL | 568 |
| RTDLDSLRTYTL | 569 |
| RTDLDSLRTY | 570 |
| RTDLDSLRT | 571 |
| RTDLDSLR | 572 |
| GDLDLLKLRLTL | 573 |
| GDLHSLRQLLSR | 574 |
| RDDLHMLRLQLW | 575 |
| SSDLHALKKRYG | 576 |
| RGDLKQLSELTW | 577 |
| RGDLAALSAPPV | 578 |

TABLE 10

Selectin antagonist peptide sequences

| Sequence/structure | SEQ ID NO: |
|---|---|
| DITWDQLWDLMK | 579 |
| DITWDELWKIMN | 580 |
| DYTWFELWDMMQ | 581 |
| QITWAQLWNMMK | 582 |
| DMTWHDLWTLMS | 583 |
| DYSWHDLWEMMS | 584 |
| EITWDQLWEVMN | 585 |
| HVSWEQLWDIMN | 586 |
| HITWDQLWRIMT | 587 |
| RNMSWLELWEHMK | 588 |
| AEWTWDQLWHVMNPAESQ | 589 |
| HRAEWLALWEQMSP | 590 |
| KKEDWLALWRIMSV | 591 |
| ITWDQLWDLMK | 592 |
| DITWDQLWDLMK | 593 |
| DITWDQLWDLMK | 594 |
| DITWDQLWDLMK | 595 |
| CQNRYTDLVAIQNKNE | 596 |
| AENWADNEPNNKRNNED | 597 |
| RKNNKTWTWVGTKKALTNE | 598 |
| KKALTNEAENWAD | 599 |
| CQXRYTDLVAIQNKXE | 600 |
| RKXNXXWTWVGTXKXLTEE | 601 |
| AENWADGEPNNKXNXED | 602 |
| CXXXYTXLVAIQNKXE | 603 |

TABLE 10-continued

Selectin antagonist peptide sequences

| Sequence/structure | SEQ ID NO: |
|---|---|
| RKXXXXWXWVGTXKXLTXE | 604 |
| AXNWXXXEPNNXXXED | 605 |
| XKXKTXEAXNWXX | 606 |

TABLE 11

Antipathogenic peptide sequences

| Sequence/structure | SEQ ID NO: |
|---|---|
| GFFALIPKIISSPLFKTLLSAVGSALSSSGGQQ | 607 |
| GFFALIPKIISSPLFKTLLSAVGSALSSSGGQE | 608 |
| GFFALIPKIISSPLFKTLLSAV | 609 |
| GFFALIPKIISSPLFKTLLSAV | 610 |
| KGFFALIPKIISSPLFKTLLSAV | 611 |
| KKGFFALIPKIISSPLFKTLLSAV | 612 |
| KKGFFALIPKIISSPLFKTLLSAV | 613 |
| GFFALIPKIIS | 614 |
| GIGAVLKVLTTGLPALISWIKRKRQQ | 615 |
| GIGAVLKVLTTGLPALISWIKRKRQQ | 616 |
| GIGAVLKVLTTGLPALISWIKRKRQQ | 617 |
| GIGAVLKVLTTGLPALISWIKR | 618 |
| AVLKVLTTGLPALISWIKR | 619 |
| KLLLLLKLLLLK | 620 |
| KLLLKLLLKLLK | 621 |
| KLLLKLKLKLLK | 622 |
| KKLLKLKLKLKK | 623 |
| KLLLKLLLKLLK | 624 |
| KLLLKLKLKLLK | 625 |
| KLLLLK | 626 |
| KLLLKLLK | 627 |
| KLLLKLKLKLLK | 628 |
| KLLLKLKLKLLK | 629 |
| KLLLKLKLKLLK | 630 |
| KAAAKAAAKAAK | 631 |
| KVVVKVVVKVVK | 632 |
| KVVVKVKVKVVK | 633 |
| KVVVKVKVKVK | 634 |

TABLE 11-continued

Antipathogenic peptide sequences

| Sequence/structure | SEQ ID NO: |
|---|---|
| KVVVKVKVKVVK | 635 |
| KLILKL | 636 |
| KVLHLL | 637 |
| LKLRLL | 638 |
| KPLHLL | 639 |
| KLILKLVR | 640 |
| KVFHLLHL | 641 |
| HKFRILKL | 642 |
| KPFHILHL | 643 |
| KIIIKIKIKIIK | 644 |
| KIIIKIKIKIIK | 645 |
| KIIIKIKIKIIK | 646 |
| KIPIKIKIKIPK | 647 |
| KIPIKIKIKIVK | 648 |
| RIIIRIRIRIIR | 649 |
| RIIIRIRIRIIR | 650 |
| RIIIRIRIRIIR | 651 |
| RIVIRIRIRLIR | 652 |
| RIIVRIRLRIIR | 653 |
| RIGIRLRVRIIR | 654 |
| KIVIRIRIRLIR | 655 |
| RIAVKWRLRFIK | 656 |
| KIGWKLRVRIIR | 657 |
| KKIGWLIIRVRR | 658 |
| RIVIRIRIRLIRIR | 659 |
| RIIVRIRLRIIRVR | 660 |
| RIGIRLRVRIIRRV | 661 |
| KIVIRIRARLIRIRIR | 662 |
| RIIVKIRLRIIKKIRL | 663 |
| KIGIKARVRIIRVKII | 664 |
| RIIVHIRLRIIHHIRL | 665 |
| HIGIKAHVRIIRVHII | 666 |
| RIYVKIHLRYIKKIRL | 667 |
| KIGHKARVHIIRYKII | 668 |
| RIYVKPHPRYIKKIRL | 669 |
| KPGHKARPHIIRYKII | 670 |
| KIVIRIRIRLIRIRIRKIV | 671 |

TABLE 11-continued

Antipathogenic peptide sequences

| Sequence/structure | SEQ ID NO: |
|---|---|
| RIIVKIRLRIIKKIRLIKK | 672 |
| KIGWKLRVRIIRVKIGRLR | 673 |
| KIVIRIRLIRIRIRKIVKVKRIR | 674 |
| RFAVKIRLRIIKKIRLIKKIRKRVIK | 675 |
| KAGWKLRVRIIRVKIGRLRKIGWKKRVRIK | 676 |
| RIYVKPHPRYIKKIRL | 677 |
| KPGHKARPHIIRYKII | 678 |
| KIVIRIRLRIRIRKIV | 679 |
| RIIVKIRLRIIKKIRLIKK | 680 |
| RIYVSKISIYIKKIRL | 681 |
| KIVIFTRIRLTSIRIRSIV | 682 |
| KPIHKARPTIIRYKMI | 683 |
| cyclicCKGFFALIPKIISSPLFKTLLSAVC | 684 |
| CKKGFFALIPKIISSPLFKTLLSAVC | 685 |
| CKKKGFFALIPKIISSPLFKTLLSAVC | 686 |
| CyclicCRIVIRIRLIRIRC | 687 |
| CyclicCKPGHKARPHIIRYKIIC | 688 |
| CyclicCRFAVKIRLRIIKKIRLIKKIRKRVIKC | 689 |
| KLLLKLLL KLLKC | 690 |
| KLLLKLLLKLLK | 691 |
| KLLLKLKLKLLKC | 692 |
| KLLLKLLLKLLK | 693 |

TABLE 12

VIP-mimetic peptide sequences

| Sequence/structure | SEQ ID NO: |
|---|---|
| HSDAVFYDNYTR LRKQMAVKKYLN SILN | 694 |
| Nle HSDAVFYDNYTR LRKQMAVKKYLN SILN | 695 |
| X₁X₁'X₁"X₂ | 696 |
| X₃SX₄LN | 697 |
| NH CH CO KKYX5 NH CH CO X6<br>    |                    |<br> (CH2)ₘ——Z——(CH2)ₙ | 698 |
| KKYL | 699 |
| NSILN | 700 |
| KKYL | 701 |
| KKYA | 702 |
| AVKKYL | 703 |
| NSILN | 704 |
| KKYV | 705 |
| SILauN | 706 |
| KKYLNle | 707 |
| NSYLN | 708 |

TABLE 12-continued

VIP-mimetic peptide sequences

| Sequence/structure | SEQ ID NO: |
|---|---|
| NSIYN | 709 |
| KKYLPPNSILN | 710 |
| LauKKYL | 711 |
| CapKKYL | 712 |
| KYL | 713 |
| KKYNle | 714 |
| VKKYL | 715 |
| LNSILN | 716 |
| YLNSILN | 717 |
| KKYLN | 718 |
| KKYLNS | 719 |
| KKYLNSI | 720 |
| KKYLNSIL | 721 |
| KKYL | 722 |
| KKYDA | 723 |
| AVKKYL | 724 |
| NSILN | 725 |
| KKYV | 726 |
| SILauN | 727 |
| NSYLN | 728 |
| NSIYN | 729 |
| KKYLNle | 730 |
| KKYLPPNSILN | 731 |
| KKYL | 732 |
| KKYDA | 733 |
| AVKKYL | 734 |
| NSILN | 735 |
| KKYV | 736 |
| SILauN | 737 |
| LauKKYL | 738 |
| CapKKYL | 739 |
| KYL | 740 |
| KYL | 741 |
| KKYNle | 742 |
| VKKYL | 743 |
| LNSILN | 744 |
| YLNSILN | 745 |
| KKYLNle | 746 |
| KKYLN | 747 |
| KKYLNS | 748 |
| KKYLNSI | 749 |
| KKYLNSIL | 750 |
| KKKYLD | 751 |
| cyclicCKKYLC | 752 |
| CKKYLK<br>|      |<br>S-CH₂-CO | 753 |
| KKYA | 754 |
| WWTDTGLW | 755 |
| WWTDDGLW | 756 |
| WWDTRGLWVWTI | 757 |
| FWGNDGIWLESG | 758 |
| DWDQFGLWRGAA | 759 |
| RWDDNGLWVVVL | 760 |
| SGMWSHYGIWMG | 761 |
| GGRWDQAGLWVA | 762 |
| KLWSEQGIWMGE | 763 |
| CWSMIIGLWLC | 764 |
| GCWDNTGIWVPC | 765 |
| DWDTRGLWVY | 766 |
| SLWDENGAWI | 767 |
| KWDDRGLWMH | 768 |
| QAWNERGLWT | 769 |
| QWDTRGLWVA | 770 |
| WNVHGIWQE | 771 |
| SWDTRGLWVE | 772 |
| DWDTRGLWVA | 773 |
| SWGRDGLWIE | 774 |
| EWTDNGLWAL | 775 |
| SWDEKGLWSA | 776 |
| SWDSSGLWMD | 777 |

TABLE 13

Mdm/hdm antagonist peptide sequences

| Sequence/structure | SEQ ID NO: |
|---|---|
| TFSDLW | 778 |
| QETFSDLWKLLP | 779 |
| QPTFSDLWKLLP | 780 |
| QETFSDYWKLLP | 781 |
| QPTFSDYWKLLP | 782 |
| MPRFMDYWEGLN | 783 |
| VQNFIDYWTQQF | 784 |
| TGPAFTHYWATF | 785 |
| IDRAPTFRDHWFALV | 786 |
| PRPALVFADYWETLY | 787 |
| PAFSRFWSDLSAGAH | 788 |
| PAFSRFWSKLSAGAH | 789 |
| PXFXDYWXXL | 790 |
| QETFSDLWKLLP | 791 |
| QPTFSDLWKLLP | 792 |
| QETFSDYWKLLP | 793 |
| QPTFSDYWKLLP | 794 |

TABLE 14

Calmodulin antagonist peptide sequences

| Sequence/structure | SEQ ID NO: |
|---|---|
| SCVKWGKKEFCGS | 795 |
| SCWKYWGKECGS | 796 |
| SCYEWGKLRWCGS | 797 |
| SCLRWGKWSNCGS | 798 |
| SCWRWGKYQICGS | 799 |
| SCVSWGALKLCGS | 800 |
| SCIRWGQNTFCGS | 801 |
| SCWQWGNLKICGS | 802 |
| SCVRWGQLSICGS | 803 |
| LKKFNARRKLKGAILTTMLAK | 804 |
| RRWKKNFIAVSAANRFKK | 805 |
| RKWQKTGHAVRAIGRLSS | 806 |
| INLKALAALAKKIL | 807 |
| KIWSILAPLGTTLVKLVA | 808 |
| LKKLLKLLKKLLKL | 809 |
| LKWKKLLKLLKKLLKKLL | 810 |

TABLE 14-continued

Calmodulin antagonist peptide sequences

| Sequence/structure | SEQ ID NO: |
|---|---|
| AEWPSLTEIKTLSHFSV | 811 |
| AEWPSPTRVISTTYFGS | 812 |
| AELAHWPPVKTVLRSFT | 813 |
| AEGSWLQLLNLMKQMNN | 814 |
| AEWPSLTEIK | 815 |

TABLE 15

Mast cell antagonists/Mast cell protease inhibitor peptide sequences

| Sequence/structure | SEQ ID NO: |
|---|---|
| SGSGVLKRPLPILPVTR | 816 |
| RWLSSRPLPPLPLPPRT | 817 |
| GSGSYDTLALPSLPLHPMSS | 818 |
| GSGSYDTRALPSLPLHPMSS | 819 |
| GSGSSGVTMYPKLPPHWSMA | 820 |
| GSGSSGVRMYPKLPPHWSMA | 821 |
| GSGSSSMRMVPTIPGSAKHG | 822 |
| RNR | NR |
| QT | NR |
| RQK | NR |
| NRQ | NR |
| RQK | NR |
| RNRQKT | 823 |
| RNRQ | 824 |
| RNRQK | 825 |
| NRQKT | 826 |
| RQKT | 827 |

TABLE 16

SH3 antagonist peptide sequences

| Sequence/structure | SEQ ID NO: |
|---|---|
| RPLPPLP | 828 |
| RELPPLP | 829 |
| SPLPPLP | 830 |
| GPLPPLP | 831 |
| RPLPIPP | 832 |

TABLE 16-continued

SH3 antagonist peptide sequences

| Sequence/structure | SEQ ID NO: |
|---|---|
| RPLPIPP | 833 |
| RRLPPTP | 834 |
| RQLPPTP | 835 |
| RPLPSRP | 836 |
| RPLPTRP | 837 |
| SRLPPLP | 838 |
| RALPSPP | 839 |
| RRLPRTP | 840 |
| RPVPPIT | 841 |
| ILAPPVP | 842 |
| RPLPMLP | 843 |
| RPLPILP | 844 |
| RPLPSLP | 845 |
| RPLPSLP | 846 |
| RPLPMIP | 847 |
| RPLPLIP | 848 |
| RPLPPTP | 849 |
| RSLPPLP | 850 |
| RPQPPPP | 851 |
| RQLPIPP | 852 |
| XXXRPLPPLPXP | 853 |
| XXXRPLPPIPXX | 854 |
| XXXRPLPPLPXX | 855 |
| RXXRPLPPLPXP | 856 |
| RXXRPLPPLPPP | 857 |
| PPPYPPPPIPXX | 858 |
| PPPYPPPPVPXX | 859 |
| LXXRPLPXΨP | 860 |
| ΨXXRPLPXLP | 861 |
| PPXΘXPPPΨP | 862 |
| +PPΨPXKPXWL | 863 |
| RPXΨPΨR+SXP | 864 |
| PPVPPRPXXTL | 865 |
| ΨPΨLPΨK | 866 |
| +ΘDXPLPXLP | 867 |

TABLE 17

Somatostatin or cortistatin mimetic peptide sequences

| Sequence/structure | SEQ ID NO: |
|---|---|
| $X^1$-$X^2$-Asn-Phe-Phe-Trp-Lys-Thr-Phe-$X^3$-Ser-$X^4$ | 868 |
| Asp Arg Met Pro Cys Arg Asn Phe Phe Trp Lys Thr Phe Ser Ser Cys Lys | 869 |
| Met Pro Cys Arg Asn Phe Phe Trp Lys Thr Phe Ser Ser Cys Lys | 870 |
| Cys Arg Asn Phe Phe Trp Lys Thr Phe Ser Ser Cys Lys | 871 |
| Asp Arg Met Pro Cys Arg Asn Phe Phe Trp Lys Thr Phe Ser Ser Cys | 872 |
| Met Pro Cys Arg Asn Phe Phe Trp Lys Thr Phe Ser Ser Cys | 873 |
| Cys Arg Asn Phe Phe Trp Lys Thr Phe Ser Ser Cys | 874 |
| Asp Arg Met Pro Cys Lys Asn Phe Phe Trp Lys Thr Phe Ser Ser Cys | 875 |
| Met Pro Cys Lys Asn Phe Phe Trp Lys Thr Phe Ser Ser Cys Lys | 876 |
| Cys Lys Asn Phe Phe Trp Lys Thr Phe Ser Ser Cys Lys | 877 |
| Asp Arg Met Pro Cys Lys Asn Phe Phe Trp Lys Thr Phe Ser Ser Cys | 878 |
| Met Pro Cys Lys Asn Phe Phe Trp Lys Thr Phe Ser Ser Cys | 879 |
| Cys Lys Asn Phe Phe Trp Lys Thr Phe Ser Ser Cys | 880 |
| Asp Arg Met Pro Cys Arg Asn Phe Phe Trp Lys Thr Phe Thr Ser Cys Lys | 881 |
| Met Pro Cys Arg Asn Phe Phe Trp Lys Thr Phe Thr Ser Cys Lys | 882 |
| Cys Arg Asn Phe Phe Trp Lys Thr Phe Thr Ser Cys Lys | 883 |
| Asp Arg Met Pro Cys Arg Asn Phe Phe Trp Lys Thr Phe Thr Ser Cys | 884 |
| Met Pro Cys Arg Asn Phe Phe Trp Lys Thr Phe Thr Ser Cys | 885 |
| Cys Arg Asn Phe Phe Trp Lys Thr Phe Thr Ser Cys | 886 |
| Asp Arg Met Pro Cys Lys Asn Phe Phe Trp Lys Thr Phe Thr Ser Cys Lys | 887 |
| Met Pro Cys Lys Asn Phe Phe Trp Lys Thr Phe Thr Ser Cys Lys | 888 |
| Cys Lys Asn Phe Phe Trp Lys Thr Phe Thr Ser Cys Lys | 889 |
| Asp Arg Met Pro Cys Lys Asn Phe Phe Trp Lys Thr Phe Thr Ser Cys | 890 |
| Met Pro Cys Lys Asn Phe Phe Trp Lys Thr Phe Thr Ser Cys | 891 |
| Cys Lys Asn Phe Phe Trp Lys Thr Phe Thr Ser Cys | 892 |

TABLE 18

UKR antagonist peptide sequences

| Sequence/structure | SEQ ID NO: |
|---|---|
| AEPMPHSLNFSQYLWYT | 893 |
| AEHTYSSLWDTYSPLAF | 894 |
| AELDLWMRHYPLSFSNR | 895 |
| AESSLWTRYAWPSMPSY | 896 |
| AEWHPGLSFGSYLWSKT | 897 |
| AEPALLNWSFFFNPGLH | 898 |
| AEWSFYNLHLPEPQTIF | 899 |
| AEPLDLWSLYSLPPLAM | 900 |
| AEPTLWQLYQFPLRLSG | 901 |
| AEISFSELMWLRS TABLE 19-continued Macrophage and/or T-cell inhibiting peptide sequences

| Sequence/structure | SEQ ID NO: |
|---|---|
| Arg-Glu | NR |
| Arg-Gly | NR |
| Arg-His | NR |
| Arg-Ile | NR |
| Arg-Leu | NR |
| Arg-Lys | NR |
| Arg-Met | NR |
| Arg-Phe | NR |
| Arg-Pro | NR |
| Arg-Ser | NR |
| Arg-Thr | NR |
| Arg-Trp | NR |
| Arg-Tyr | NR |
| Arg-Val | NR |
| Arg-Glu-Ala | NR |
| Arg-Glu-Asn | NR |
| Arg-Glu-Asp | NR |
| Arg-Glu-Cys | NR |
| Arg-Glu-Gln | NR |
| Arg-Glu-Glu | NR |
| Arg-Glu-Gly | NR |
| Arg-Glu-His | NR |
| Arg-Glu-Ile | NR |
| Arg-Glu-Leu | NR |
| Arg-Glu-Lys | NR |
| Arg-Glu-Met | NR |
| Arg-Glu-Phe | NR |
| Arg-Glu-Pro | NR |
| Arg-Glu-Ser | NR |
| Arg-Glu-Thr | NR |
| Arg-Glu-Trp | NR |
| Arg-Glu-Tyr | NR |
| Arg-Glu-Val | NR |
| Ala-Arg-Glu | NR |
| Arg-Arg-Glu | NR |
| Asn-Arg-Glu | NR |
| Asp-Arg-Glu | NR |
| Cys-Arg-Glu | NR |
| Gln-Arg-Glu | NR |
| Glu-Arg-Glu | NR |
| Gly-Arg-Glu | NR |
| His-Arg-Glu | NR |
| Ile-Arg-Glu | NR |
| Leu-Arg-Glu | NR |
| Lys-Arg-Glu | NR |
| Met-Arg-Glu | NR |
| Phe-Arg-Glu | NR |
| Pro-Arg-Glu | NR |
| Ser-Arg-Glu | NR |
| Thr-Arg-Glu | NR |
| Trp-Arg-Glu | NR |
| Tyr-Arg-Glu | NR |
| Val-Arg-Glu | NR |
| Glu-Arg-Ala, | NR |
| Glu-Arg-Arg | NR |
| Glu-Arg-Asn | NR |
| Glu-Arg-Asp | NR |
| Glu-Arg-Cys | NR |
| Glu-Arg-Gln | NR |
| Glu-Arg-Gly | NR |
| Glu-Arg-His | NR |
| Glu-Arg-Ile | NR |
| Glu-Arg-Leu | NR |
| Glu-Arg-Lys | NR |
| Glu-Arg-Met | NR |
| Glu-Arg-Phe | NR |
| Glu-Arg-Pro | NR |
| Glu-Arg-Ser | NR |
| Glu-Arg-Thr | NR |
| Glu-Arg-Trp | NR |
| Glu-Arg-Tyr | NR |
| Glu-Arg-Val | NR |

TABLE 20

Additional Exemplary Pharmacologically Active Peptides

| Sequence/structure | SEQ ID NO | Activity |
|---|---|---|
| VEPNCDIHVMWEWECFERL | 915 | VEGF-antagonist |
| GERWCFDGPLTWVCGEES | 916 | VEGF-antagonist |
| RGWVEICVADDNGMCVTEAQ | 917 | VEGF-antagonist |
| GWDECDVARMWEWECFAGV | 918 | VEGF-antagonist |
| GERWCFDGPRAWVCGWEI | 919 | VEGF-antagonist |
| EELWCFDGPRAWVCGYVK | 920 | VEGF-antagonist |
| RGWVEICAADDYGRCLTEAQ | 921 | VEGF-antagonist |
| RGWVEICESDVWGRCL | 922 | VEGF-antagonist |
| RGWVEICESDVWGRCL | 923 | VEGF-antagonist |
| GGNECDIARMWEWECFERL | 924 | VEGF-antagonist |
| RGWVEICAADDYGRCL | 925 | VEGF-antagonist |
| CTTHWGFTLC | 926 | MMP inhibitor |
| CLRSGXGC | 927 | MMP inhibitor |
| CXXHWGFXXC | 928 | MMP inhibitor |
| CXPXC | 929 | MMP inhibitor |
| CRRHWGFEFC | 930 | MMP inhibitor |
| STTHWGFTLS | 931 | MMP inhibitor |
| CSLHWGFWWC | 932 | CTLA4-mimetic |
| GFVCSGIFAVGVGRC | 933 | CTLA4-mimetic |
| APGVRLGCAVLGRYC | 934 | CTLA4-mimetic |
| LLGRMK | 935 | Antiviral (HBV) |
| ICVVQDWGHHRCTAGHMANLTSHASAI | 936 | C3b antagonist |
| ICVVQDWGHHRCT | 937 | C3b antagonist |
| CVVQDWGHHAC | 938 | C3b antagonist |
| STGGFDDVYDWARGVSSALTTTLVATR | 939 | Vinculin-binding |
| STGGFDDVYDWARRVSSALTTTLVATR | 940 | Vinculin-binding |
| SRGVNFSEWLYDMSAAMKEASNVFPSRRSR | 941 | Vinculin-binding |
| SSQNWDMEAGVEDLTAAMLGLLSTIHSSSR | 942 | Vinculin-binding |
| SSPSLYTQFLVNYESAATRIQDLLIASRPSR | 943 | Vinculin-binding |
| SSTGWVDLLGALQRAADATRTSIPPSLQNSR | 944 | Vinculin-binding |
| DVYTKKELIECARRVSEK | 945 | Vinculin-binding |
| EKGSYYPGSGIAQFHIDYNNVS | 946 | C4BP-binding |
| SGIAQFHIDYNNVSSAEGWHVN | 947 | C4BP-binding |
| LVTVEKGSYYPGSGIAQFHIDYNNVSSAEGWHVN | 948 | C4BP-binding |
| SGIAQFHIDYNNVS | 949 | C4BP-binding |
| LLGRMK | 950 | anti-HBV |
| ALLGRMKG | 951 | anti-HBV |
| LDPAFR | 952 | anti-HBV |
| CXXRGDC | 953 | Inhibition of platelet aggregation |
| RPLPPLP | 954 | Src antagonist |
| PPVPPR | 955 | Src antagonist |
| XFXDXWXXLXX | 956 | Anti-cancer (particularly for sarcomas) |
| KACRRLFGPVDSEQLSRDCD | 957 | p16-mimetic |
| RERWNFDFVTETPLEGDFAW | 958 | p16-mimetic |
| KRRQTSMTDFYHSKRRLIFS | 959 | p16-mimetic |
| TSMTDFYHSKRRLIFSKRKP | 960 | p16-mimetic |
| RRLIF | 961 | p16-mimetic |
| KRRQTSATDFYHSKRRLIFSRQIKIWFQNRRMKWKK | 962 | p16-mimetic |
| KRRLLFSKRQLKIWFQNRRMKWKK | 963 | p16-mimetic |
| Asn Gln Gly Arg His Phe Cys Gly Gly Ala Leu Ile His Ala Arg Phe Val Met Thr Ala Ala Ser Cys Phe Gln | 964 | CAP37 mimetic/LPS binding |
| Arg His Phe Cys Gly Gly Ala Leu Ile His Ala Arg Phe Val Met Thr Ala Ala Ser Cys | 965 | CAP37 mimetic/LPS binding |
| Gly Thr Arg Cys Gln Val Ala Gly Trp Gly Ser Gln Arg Ser Gly Gly Arg Leu Ser Arg Phe Pro Arg Phe Val Asn Val | 966 | CAP37 mimetic/LPS binding |
| WHWRHRIPLQLAAGR | 967 | carbohydrate (GDI alpha) mimetic |
| LKTPRV | 968 | β2GPI Ab binding |
| NTLKTPRV | 969 | β2GPI Ab binding |
| NTLKTPRVGGC | 970 | β2GPI Ab binding |
| KDKATF | 971 | β2GPI Ab binding |
| KDKATFGCHD | 972 | β2GPI Ab binding |
| KDKATFGCHDGC | 973 | β2GPI Ab binding |
| TLRVYK | 974 | β2GPI Ab binding |
| ATLRVYKGG | 975 | β2GPI Ab binding |
| CATLRVYKGG | 976 | β2GPI Ab binding |
| INLKALAALAKKIL | 977 | Membrane-transporting |

TABLE 20-continued

Additional Exemplary Pharmacologically Active Peptides

| Sequence/structure | SEQ ID NO: | Activity |
|---|---|---|
| GWT | NR | Membrane-transporting |
| GWTLNSAGYLLG | 978 | Membrane-transporting |
| GWTLNSAGYLLGKINLKALAALAKKIL | 979 | Membrane-transporting |
| CVHAYRS | 980 | Antiproliferative, antiviral |
| CVHAYRA | 981 | Antiproliferative, antiviral |
| CVHAPRS | 982 | Antiproliferative, antiviral |
| CVHAPRA | 983 | Antiproliferative, antiviral |
| CVHSYRS | 984 | Antiproliferative, antiviral |
| CVHSYRA | 985 | Antiproliferative, antiviral |
| CVHSPRS | 986 | Antiproliferative, antiviral |
| CVHSPRA | 987 | Antiproliferative, antiviral |
| CVHTYRS | 988 | Antiproliferative, antiviral |
| CVHTYRA | 989 | Antiproliferative, antiviral |
| CVHTPRS | 990 | Antiproliferative, antiviral |
| CVHTPRA | 991 | Antiproliferative, antiviral |
| HWAWFK | 992 | anti-ischemic, growth hormone-liberating |

TABLE 21

MYOSTATIN INHIBITOR PEPTIDES

| PEPTIBODY NAME | SEQ ID | PEPTIDE SEQUENCE |
|---|---|---|
| Myostatin-TN8-Con1 | 1036 | KDKCKMWHWMCKPP |
| Myostatin-TN8-Con2 | 1037 | KDLCAMWHWMCKPP |
| Myostatin-TN8-Con3 | 1038 | KDLCKMWKWMCKPP |
| Myostatin-TN8-Con4 | 1039 | KDLCKMWHWMCKPK |
| Myostatin-TN8-Con5 | 1040 | WYPCYEFHFWCYDL |
| Myostatin-TN8-Con6 | 1041 | WYPCYEGHFWCYDL |
| Myostatin-TN8-Con7 | 1042 | IFGCKWWDVQCYQF |
| Myostatin-TN8-Con8 | 1043 | IFGCKWWDVDCYQF |
| Myostatin-TN8-Con9 | 1044 | ADWCVSPNWFCMVM |
| Myostatin-TN8-Con10 | 1045 | HKFCPWWALFCWDF |
| Myostatin-TN8-1 | 1046 | KDLCKMWHWMCKPP |
| Myostatin-TN8-2 | 1047 | IDKCAIWGWMCPPL |
| Myostatin-TN8-3 | 1048 | WYPCGEFGMWCLNV |
| Myostatin-TN8-4 | 1049 | WFTCLWNCDNE |
| Myostatin-TN8-5 | 1050 | HTPCPWFAPLCVEW |
| Myostatin-TN8-6 | 1051 | KEWCWRWKWMCKPE |
| Myostatin-TN8-7 | 1052 | FETCPSWAYFCLDI |
| Myostatin-TN8-8 | 1053 | AYKCEANDWGCWWL |
| Myostatin-TN8-9 | 1054 | NSWCEDQWHRCWWL |
| Myostatin-TN8-10 | 1055 | WSACYAGHFWCYDL |
| Myostatin-TN8-11 | 1056 | ANWCVSPNWFCMVM |
| Myostatin-TN8-12 | 1057 | WTECYQQEFWCWNL |
| Myostatin-TN8-13 | 1058 | ENTCERWKWMCPPK |
| Myostatin-TN8-14 | 1059 | WLPCHQEGFWCMNF |
| Myostatin-TN8-15 | 1060 | STMCSQWHWMCNPF |
| Myostatin-TN8-16 | 1061 | IFGCHWWDVDCYQF |
| Myostatin-TN8-17 | 1062 | IYGCKWWDIQCYDI |
| Myostatin-TN8-18 | 1063 | PDWCIDPDWWCKFW |
| Myostatin-TN8-19 | 1064 | QGHCTRWPWMCPPY |
| Myostatin-TN8-20 | 1065 | WQECYREGFWCLQT |
| Myostatin-TN8-21 | 1066 | WFDCYGPGFKCWSP |
| Myostatin-TN8-22 | 1067 | GVRCPKGHLWCLYP |
| Myostatin-TN8-23 | 1068 | HWACGYWPWSCKWV |
| Myostatin-TN8-24 | 1069 | GPACHSPWWWCVFG |
| Myostatin-TN8-25 | 1070 | TTWCISPMWFCSQQ |
| Myostatin-TN8-26 | 1071 | HKFCPPWAIFCWDF |
| Myostatin-TN8-27 | 1072 | PDWCVSPRWYCNMW |
| Myostatin-TN8-28 | 1073 | VWKCHWFGMDCEPT |
| Myostatin-TN8-29 | 1074 | KKHCQIWTWMCAPK |
| Myostatin-TN8-30 | 1075 | WFQCGSTLFWCYNL |
| Myostatin-TN8-31 | 1076 | WSPCYDHYFYCYTI |
| Myostatin-TN8-32 | 1077 | SWMCGFFKEVCMWV |
| Myostatin-TN8-33 | 1078 | EMLCMIHPVFCNPH |
| Myostatin-TN8-34 | 1079 | LKTCNLWPWMCPPL |
| Myostatin-TN8-35 | 1080 | VVGCKWYEAWCYNK |

TABLE 21-continued

MYOSTATIN INHIBITOR PEPTIDES

| PEPTIBODY NAME | SEQ ID | PEPTIDE SEQUENCE |
|---|---|---|
| Myostatin-TN8-36 | 1081 | PIHCTQWAWMCPPT |
| Myostatin-TN8-37 | 1082 | DSNCPWYFLSCVIF |
| Myostatin-TN8-38 | 1083 | HIWCNLAMMXCVEM |
| Myostatin-TN8-39 | 1084 | NLQCIYFLGKCIYF |
| Myostatin-TN8-40 | 1085 | AWRCMWFSDVCTPG |
| Myostatin-TN8-41 | 1086 | WFRCFLDADWCTSV |
| Myostatin-TN8-42 | 1087 | EKICQMWSWMCAPP |
| Myostatin-TN8-43 | 1088 | WFYCHLNKSECTEP |
| Myostatin-TN8-44 | 1089 | FWRCAIGIDKCKRV |
| Myostatin-TN8-45 | 1090 | NLGCKWYEVWCFTY |
| Myostatin-TN8-46 | 1091 | IDLCNMWDGMCYPP |
| Myostatin-TN8-47 | 1092 | EMPCNIWGWMCPPV |
| Myostatin-TN12-1 | 1093 | WFRCVLTGIVDWSECFGL |
| Myostatin-TN12-2 | 1094 | GFSCTFGLDEFYVDCSPF |
| Myostatin-TN12-3 | 1095 | LPWCHDQVNADWGFCMLW |
| Myostatin-TN12-4 | 1096 | YPTCSEKFWIYGQTCVLW |
| Myostatin-TN12-5 | 1097 | LGPCPIHHGPWPQYCVYW |
| Myostatin-TN12-6 | 1098 | PFPCETHQISWLGHCLSF |
| Myostatin-TN12-7 | 1099 | HWGCEDLMWSWHPLCRRLP |
| Myostatin-TN12-8 | 1100 | LPLCDADMMPTIGFCVAY |
| Myostatin-TN12-9 | 1101 | SHWCETTFWMNYAKCVHA |
| Myostatin-TN12-10 | 1102 | LPKCTHVPFDQGGFCLWY |
| Myostatin-TN12-11 | 1103 | FSSCWSPVSRQDMFCVFY |
| Myostatin-TN12-13 | 1104 | SHKCEYSGWLQPLCYRP |
| Myostatin-TN12-14 | 1105 | PWWCQDNYVQHMLHCDSP |
| Myostatin-TN12-15 | 1106 | WFRCMLMNSFDAFQCVSY |
| Myostatin-TN12-16 | 1107 | PDACRDQPWYMFMGCMLG |
| Myostatin-TN12-17 | 1108 | FLACFVEFELCFDS |
| Myostatin-TN12-18 | 1109 | SAYCIITESDPYVLCVPL |
| Myostatin-TN12-19 | 1110 | PSICESYSTMWLPMCQHN |
| Myostatin-TN12-20 | 1111 | WLDCHDDSWAWTKMCRSH |
| Myostatin-TN12-21 | 1112 | YLNCVMMNTSPFVECVFN |
| Myostatin-TN12-22 | 1113 | YPWCDGFMIQQGITCMFY |
| Myostatin-TN12-23 | 1114 | FDYCTWLNGFKDWKCWSR |
| Myostatin-TN12-24 | 1115 | LPLCNLKEISHVQACVLF |
| Myostatin-TN12-25 | 1116 | SPECAFARWLGIEQCQRD |
| Myostatin-TN12-26 | 1117 | YPQCFNLHLLEWTECDWF |
| Myostatin-TN12-27 | 1118 | RWRCEIYDSEFLPKCWFF |
| Myostatin-TN12-28 | 1119 | LVGCDNVWHRCKLF |
| Myostatin-TN12-29 | 1120 | AGWCHVWGEMFGMGCSAL |
| Myostatin-TN12-30 | 1121 | HHECEWMARWMSLDCVGL |
| Myostatin-TN12-31 | 1122 | FPMCGIAGMKDFDFCVWY |
| Myostatin-TN12-32 | 1123 | RDDCTFWPEWLWKLCERP |
| Myostatin-TN12-33 | 1124 | YNFCSYLFGVSKEACQLP |
| Myostatin-TN12-34 | 1125 | AHWCEQGPWRYGNICMAY |
| Myostatin-TN12-35 | 1126 | NLVCGKISAWGDEACARA |
| Myostatin-TN12-36 | 1127 | HNVCTIMGPSMKWFCWND |
| Myostatin-TN12-37 | 1128 | NDLCAMWGWRNTIWCQNS |
| Myostatin-TN12-38 | 1129 | PPFCQNDNDMLQSLCKLL |
| Myostatin-TN12-39 | 1130 | WYDCNVPNELLSGLCRLF |
| Myostatin-TN12-40 | 1131 | YGDCDQNHWMWPFTCLSL |
| Myostatin-TN12-41 | 1132 | GWMCHFDLHDWGATCQPD |
| Myostatin-TN12-42 | 1133 | YFHCMFGGHEFEVHCESF |
| Myostatin-TN12-43 | 1134 | AYWCWHGQCVRF |
| Myostatin-Linear-1 | 1135 | SEHWTFTDWDGNEWWVRPF |
| Myostatin-Linear-2 | 1136 | MEMLDSLFELLKDMVPISKA |
| Myostatin-Linear-3 | 1137 | SPPEEALMEWLGWQYGKFT |
| Myostatin-Linear-4 | 1138 | SPENLLNDLYILMTKQEWYG |
| Myostatin-Linear-5 | 1139 | FHWEEGIPFHVVTPYSYDRM |
| Myostatin-Linear-6 | 1140 | KRLLEQFMNDLAELVSGHS |
| Myostatin-Linear-7 | 1141 | DTRDALFQEFYEFVRSRLVI |
| Myostatin-Linear-8 | 1142 | RMSAAPRPLTYRDIMDQYWH |
| Myostatin-Linear-9 | 1143 | NDKAHFFEMFMFDVHNFVES |
| Myostatin-Linear-10 | 1144 | QTQAQKIDGLWELLQSIRNQ |
| Myostatin-Linear-11 | 1145 | MLSEFEEFLGNLVHRQEA |
| Myostatin-Linear-12 | 1146 | YTPKMGSEWTSFWHNRIHYL |
| Myostatin-Linear-13 | 1147 | LNDTLLRELKMVLNSLSDMK |
| Myostatin-Linear-14 | 1148 | FDVERDLMRWLEGFMQSAAT |
| Myostatin-Linear-15 | 1149 | HHGWNYLRKGSAPQWFEAWV |
| Myostatin-Linear-16 | 1150 | VESLHQLQMWLDQKLASGPH |
| Myostatin-Linear-17 | 1151 | RATLLKDFWQLVEGYGDN |
| Myostatin-Linear-18 | 1152 | EELLREFYRFVSAFDY |
| Myostatin-Linear-19 | 1153 | GLLDEFSHFIAEQFYQMPGG |
| Myostatin-Linear-20 | 1154 | YREMSMLEGLLDVLERLQHY |
| Myostatin-Linear-21 | 1155 | HNSSQMLLSELIMLVGSMMQ |

TABLE 21-continued

MYOSTATIN INHIBITOR PEPTIDES

| PEPTIBODY NAME | SEQ ID | PEPTIDE SEQUENCE |
|---|---|---|
| Myostatin-Linear-22 | 1156 | WREHFLNSDYIRDKLIAIDG |
| Myostatin-Linear-23 | 1157 | QFPFYVFDDLPAQLEYWIA |
| Myostatin-Linear-24 | 1158 | EFFHWLHNHRSEVNHWLDMN |
| Myostatin-Linear-25 | 1159 | EALFQNFFRDVLTLSEREY |
| Myostatin-Linear-26 | 1160 | QYWEQQWMTYFRENGLHVQY |
| Myostatin-Linear-27 | 1161 | NQRMMLEDLWRIMTPMFGRS |
| Myostatin-Linear-29 | 1162 | FLDELKAELSRHYALDDLDE |
| Myostatin-Linear-30 | 1163 | GKLIEGLLNELMQLETFMPD |
| Myostatin-Linear-31 | 1164 | ILLLDEYKKDWKSWF |
| Myostatin-2xTN8-19 kc | 1165 | QGHCTRWPWMCPPYGSGSATGGSGSTASSGSGSATGQGHCTRWPWMCPPY |
| Myostatin-2xTN8-con6 | 1166 | WYPCYEGHFWCYDLGSGSTASSGSGSATGWYPCYEGHFWCYDL |
| Myostatin-2xTN8-5 kc | 1167 | HTPCPWFAPLCVEWGSGSATGGSGSTASSGSGSATGHTPCPWFAPLCVEW |
| Myostatin-2xTN8-18 kc | 1168 | PDWCIDPDWWCKFWGSGSATGGSGSTASSGSGSATGPDWCIDPDWWCKFW |
| Myostatin-2xTN8-11 kc | 1169 | ANWCVSPNWFCMVMGSGSATGGSGSTASSGSGSATGANWCVSPNWFCMVM |
| Myostatin-2xTN8-25 kc | 1170 | PDWCIDPDWWCKFWGSGSATGGSGSTASSGSGSATGPDWCIDPDWWCKFW |
| Myostatin-2xTN8-23 kc | 1171 | HWACGYWPWSCKWVGSGSATGGSGSTASSGSGSATGHWACGYWPWSCKWV |
| Myostatin-TN8-29-19 kc | 1172 | KKHCQIWTWMCAPKGSGSATGGSGSTASSGSGSATGQGHCTRWPWMCPPY |
| Myostatin-TN8-19-29 kc | 1173 | QGHCTRWPWMCPPYGSGSATGGSGSTASSGSGSATGKKHCQIWTWMCAPK |
| Myostatin-TN8-29-19 kn | 1174 | KKHCQIWTWMCAPKGSGSATGGSGSTASSGSGSATGQGHCTRWPWMCPPY |
| Myostatin-TN8-29-19-8 g | 1175 | KKHCQIWTWMCAPKGGGGGGGQGHCTRWPWMCPPY |
| Myostatin-TN8-19-29-6 gc | 1176 | QGHCTRWPWMCPPYGGGGGGKKHCQIWTWMCAPK |

TABLE 22

MYOSTATIN INHIBITOR PEPTIDES

| Affinity-matured peptibody | SEQ ID NO: | Peptide sequence |
|---|---|---|
| mTN8-19-1 | 1177 | VALHGQCTRWPWMCPPQREG |
| mTN8-19-2 | 1178 | YPEQGLCTRWPWMCPPQTLA |
| mTN8-19-3 | 1179 | GLNQGHCTRWPWMCPPQDSN |
| mTN8-19-4 | 1180 | MITQGQCTRWPWMCPPQPSG |
| mTN8-19-5 | 1181 | AGAQEHCTRWPWMCAPNDWI |
| mTN8-19-6 | 1182 | GVNQGQCTRWRWMCPPNGWE |
| mTN8-19-7 | 1183 | LADHGQCIRWPWMCPPEGWE |
| mTN8-19-8 | 1184 | ILEQAQCTRWPWMCPPQRGG |
| mTN8-19-9 | 1185 | TQTHAQCTRWPWMCPPQWEG |
| mTN8-19-10 | 1186 | VVTQGHCTLWPWMCPPQRWR |
| mTN8-19-11 | 1187 | IYPHDQCTRWPWMCPPQPYP |
| mTN8-19-12 | 1188 | SYWQGQCTRWPWMCPPQWRG |
| mTN8-19-13 | 1189 | MWQQGHCTRWPWMCPPQGWG |
| mTN8-19-14 | 1190 | EFTQWHCTRWPWMCPPQRSQ |
| mTN8-19-15 | 1191 | LDDQWQCTRWPWMCPPQGFS |
| mTN8-19-16 | 1192 | YQTQGLCTRWPWMCPPQSQR |
| mTN8-19-17 | 1193 | ESNQGQCTRWPWMCPPQGGW |
| mTN8-19-18 | 1194 | WTDRGPCTRWPWMCPPQANG |
| mTN8-19-19 | 1195 | VGTQGQCTRWPWMCPPYETG |
| mTN8-19-20 | 1196 | PYEQGKCTRWPWMCPPYEVE |
| mTN8-19-21 | 1197 | SEYQGLCTRWPWMCPPQGWK |
| mTN8-19-22 | 1198 | TFSQGHCTRWPWMCPPQGWG |
| mTN8-19-23 | 1199 | PGAHDHCTRWPWMCPPQSRY |
| mTN8-19-24 | 1200 | VAEEWHCRRWPWMCPPQDWR |
| mTN8-19-25 | 1201 | VGTQGHCTRWPWMCPPQPAG |
| mTN8-19-26 | 1202 | EEDQAHCRSWPWMCPPQGWV |
| mTN8-19-27 | 1203 | ADTQGHCTRWPWMCPPQHWF |
| mTN8-19-28 | 1204 | SGPQGHCTRWPWMCAPQGWF |
| mTN8-19-29 | 1205 | TLVQGHCTRWPWMCPPQRWV |
| mTN8-19-30 | 1206 | GMAHGKCTRWAWMCPPQSWK |
| mTN8-19-31 | 1207 | ELYHGQCTRWPWMCPPQSWA |
| mTN8-19-32 | 1208 | VADHGHCTRWPWMCPPQGWG |
| mTN8-19-33 | 1209 | PESQGHCTRWPWMCPPQGWG |
| mTN8-19-34 | 1210 | IPAHGHCTRWPWMCPPQRWR |
| mTN8-19-35 | 1211 | FTVHGHCTRWPWMCPPYGWV |
| mTN8-19-36 | 1212 | PDFPGHCTRWRWMCPPQGWE |
| mTN8-19-37 | 1213 | QLWQGPCTQWPWMCPPKGRY |

TABLE 22-continued

MYOSTATIN INHIBITOR PEPTIDES

| Affinity-matured peptibody | SEQ ID NO: | Peptide sequence |
|---|---|---|
| mTN8-19-38 | 1214 | HANDGHCTRWQWMCPPQWGG |
| mTN8-19-39 | 1215 | ETDHGLCTRWPWMCPPYGAR |
| mTN8-19-40 | 1216 | GTWQGLCTRWPWMCPPQGWQ |
| mTN8-19 con1 | 1217 | VATQGQCTRWPWMCPPQGWG |
| mTN8-19 con2 | 1218 | VATQGQCTRWPWMCPPQRWG |
| mTN8 con6-1 | 1219 | QREWYPCYGGHLWCYDLHKA |
| mTN8 con6-2 | 1220 | ISAWYSCYAGHFWCWDLKQK |
| mTN8 con6-3 | 1221 | WTGWYQCYGGHLWCYDLRRK |
| mTN8 con6-4 | 1222 | KTFWYPCYDGHFWCYNLKSS |
| mTN8 con6-5 | 1223 | ESRWYPCYEGHLWCFDLTET |

TABLE 23

MYOSTATIN INHIBITOR PEPTIDES

| Affinity matured peptibody | SEQ ID NO: | Peptide Sequence |
|---|---|---|
| L2 | 1224 | MEMLDSLFELLKDMVPISKA |
| mL2-Con1 | 1225 | RMEMLESLLELLKEIVPMSKAG |
| mL2-Con2 | 1226 | RMEMLESLLELLKEIVPMSKAR |
| mL2-1 | 1227 | RMEMLESLLELLKDIVPMSKPS |
| mL2-2 | 1228 | GMEMLESLFELLQEIVPMSKAP |
| mL2-3 | 1229 | RMEMLESLLELLKDIVPISNPP |
| mL2-4 | 1230 | RIEMLESLLELLQEIVPISKAE |
| mL2-5 | 1231 | RMEMLQSLLELLKDIVPMSNAR |
| mL2-6 | 1232 | RMEMLESLLELLKEIVPTSNGT |
| mL2-7 | 1233 | RMEMLESLFELLKEIVPMSKAG |
| mL2-8 | 1234 | RMEMLGSLLELLKEIVPMSKAR |
| mL2-9 | 1235 | QMELLDSLFELLKEIVPKSQPA |
| mL2-10 | 1236 | RMEMLDSLLELLKEIVPMSNAR |
| mL2-11 | 1237 | RMEMLESLLELLHEIVPMSQAG |
| mL2-12 | 1238 | QMEMLESLLQLLKEIVPMSKAS |
| mL2-13 | 1239 | RMEMLDSLLELLKDMVPMTTGA |
| mL2-14 | 1240 | RIEMLESLLELLKDMVPMANAS |
| mL2-15 | 1241 | RMEMLESLLQLLNEIVPMSRAR |
| mL2-16 | 1242 | RMEMLESLFDLLKELVPMSKGV |
| mL2-17 | 1243 | RIEMLESLLELLKDIVPIQKAR |
| mL2-18 | 1244 | RMELLESLFELLKDMVPMSDSS |
| mL2-19 | 1245 | RMEMLESLLEVLQEIVPRAKGA |
| mL2-20 | 1246 | RMEMLDSLLQLLNEIVPMSHAR |
| mL2-21 | 1247 | RMEMLESLLELLKDIVPMSNAG |
| mL2-22 | 1248 | RMEMLQSLFELLKGMVPISKAG |
| mL2-23 | 1249 | RMEMLESLLELLKEIVPNSTAA |
| mL2-24 | 1250 | RMEMLQSLLELLKEIVPISKAG |
| mL2-25 | 1251 | RIEMLDSLLELLNELVPMSKAR |
| L-15 | 1252 | HHGWNYLRKGSAPQWFEAWV |
| mL15-con1 | 1253 | QVESLQQLLMWLDQKLASGPQG |
| mL15-1 | 1254 | RMELLESLFELLKEMVPRSKAV |
| mL15-2 | 1255 | QAVSLQHLLMWLDQKLASGPQH |
| mL15-3 | 1256 | DEDSLQQLLMWLDQKLASGPQL |
| mL15-4 | 1257 | PVASLQQLLIWLDQKLAQGPHA |
| mL15-5 | 1258 | EVDELQQLLNWLDHKLASGPLQ |
| mL15-6 | 1259 | DVESLEQQLMWLDHQLASGPHG |
| mL15-7 | 1260 | QVDSLQQVLLWLEHKLALGPQV |
| mL15-8 | 1261 | GDESLQHLLMWLEQKLALGPHG |
| mL15-9 | 1262 | QIEMLESLLDLLRDMVPMSNAF |
| mU15-10 | 1263 | EVDSLQQLLMWLDQKLASGPQA |
| mL15-11 | 1264 | EDESLQQLLIYLDKMLSSGPQV |
| mL15-12 | 1265 | AMDQLHQLLIWLDHKLASGPQA |
| mL15-13 | 1266 | RIEMLESLLELLDEIALIPKAW |
| mL15-14 | 1267 | EVVSLQHLLMWLEHKLASGPDG |
| mL15-15 | 1268 | GGESLQQLLMWLDQQLASGPQR |
| mL15-16 | 1269 | GVESLQQLLIFLDHMLVSGPHD |
| mL15-17 | 1270 | NVESLEHLMMWLERLLASGPYA |
| mL15-18 | 1271 | QVDSLQQLLIWLDHQLASGPKR |
| mL15-19 | 1272 | EVESLQQLLMWLEHKLAQGPQG |
| mL15-20 | 1273 | EVDSLQQLLMWLDQKLASGPHA |
| mL15-21 | 1274 | EVDSLQQLLMWLDQQLASGPQK |
| mL15-22 | 1275 | GVEQLPQLLMWLEQKLASGPQR |
| mL15-23 | 1276 | GEDSLQQLLMWLDQQLAAGPQV |
| mL15-24 | 1277 | ADDSLQQLLMWLDRKLASGPHV |
| mL15-25 | 1278 | PVDSLQQLLIWLDQKLASGPQG |
| L-17 | 1279 | RATLLKDFWQLVEGYGDN |
| mL17-con1 | 1280 | DWRATLLKEFWQLVEGLGDNLV |
| mL17-con2 | 1281 | QSRATLLKEFWQLVEGLGDKQA |
| mL17-1 | 1282 | DGRATLLTEFWQLVQGLGQKEA |

TABLE 23-continued

MYOSTATIN INHIBITOR PEPTIDES

| Affinity matured peptibody | SEQ ID NO: | Peptide Sequence |
|---|---|---|
| mL17-2 | 1283 | LARATLLKEFWQLVEGLGEKVV |
| mL17-3 | 1284 | GSRDTLLKEFWQLVVGLGDMQT |
| mL17-4 | 1285 | DARATLLKEFWQLVDAYGDRMV |
| mL17-5 | 1286 | NDRAQLLRDFWQLVDGLGVKSW |
| mL17-6 | 1287 | GVRETLLYELWYLLKGLGANQG |
| mL17-7 | 1288 | QARATLLKEFCQLVGCQGDKLS |
| mL17-8 | 1289 | QERATLLKEFWQLVAGLGQNMR |
| mL17-9 | 1290 | SGRATLLKEFWQLVQGLGEYRW |
| mL17-10 | 1291 | TMRATLLKEFWLFVDGQREMQW |
| mL17-11 | 1292 | GERATLLNDFWQLVDGQGDNTG |
| mL17-12 | 1293 | DERETLLKEFWQLVHGWGDNVA |
| mL17-13 | 1294 | GGRATLLKELWQLLEGQGANLV |
| mL17-14 | 1295 | TARATLLNELVQLVKGYGDKLV |
| mL17-15 | 1295 | GMRATLLQEFWQLVGGQGDNWM |
| mL17-16 | 1297 | STRATLLNDLWQLMKGWAEDRG |
| mL17-17 | 1298 | SERATLLKELWQLVGGWGDNFG |
| mL17-18 | 1299 | VGRATLLKEFWQLVEGLVGQSR |
| mL17-19 | 1300 | EIRATLLKEFWQLVDEWREQPN |
| mE17-20 | 1301 | QLRATLLKEFLQLVHGLGETDS |
| mL17-21 | 1302 | TQRATLLKEFWQLIEGLGGKHV |
| mL17-22 | 1303 | HYRATLLKEFWQLVDGLREQGV |
| mL17-23 | 1304 | QSRVTLLREFWQLVESYRPIVN |
| mL17-24 | 1305 | LSRATLLNEFWQFVDGQRDKRM |
| mE17-25 | 1306 | WDRATLLNDFWHLMEELSQKPG |
| mL17-26 | 1307 | QERATLLKEFWRMVEGLGKNRG |
| mL17-27 | 1308 | NERATLLREFWQLVGGYGVNQR |
| L-20 | 1309 | YREMSMLEGLLDVLERLQHY |
| mL20-1 | 1310 | HQRDMSMLWELLDVLDGLRQYS |
| mL20-2 | 1311 | TQRDMSMLDGLLEVLDQLRQQR |
| mL20-3 | 1312 | TSRDMSLLWELLEELDRLGHQR |
| mL20-4 | 1313 | MQHDMSMLYGLVELLESLGHQI |
| mL20-5 | 1314 | WNRDMRMLESLFEVLDGLRQQV |
| mL20-6 | 1315 | GYRDMSMLEGLLAVLDRLGPQL |
| mL20 con1 | 1316 | TQRDMSMLEGLLEVLDRLGQQR |
| mL20 con2 | 1317 | WYRDMSMLEGLLEVLDRLGQQR |
| L-21 | 1318 | HNSSQMLLSELIMLVGSMMQ |
| mL21-1 | 1319 | TQNSRQMLLSDFMMLVGSMIQG |

TABLE 23-continued

MYOSTATIN INHIBITOR PEPTIDES

| Affinity matured peptibody | SEQ ID NO: | Peptide Sequence |
|---|---|---|
| mL21-2 | 1320 | MQTSRHILLSEFMMLVGSIMHG |
| mL21-3 | 1321 | HDNSRQMLLSDLLHLVGTMIQG |
| mL21-4 | 1322 | MENSRQNLLRELIMLVGNMSHQ |
| mL21-5 | 1323 | QDTSRHMLLREFMMLVGEMIQG |
| mL21 con1 | 1324 | DQNSRQMLLSDLMILVGSMIQG |
| L-24 | 1325 | EFFHWLHNHRSEVNHWLDMN |
| mL24-1 | 1326 | NVFFQWVQKHGRVVYQWLDINV |
| mL24-2 | 1327 | FDFLQWLQNHRSEVEHWLVMDV |

TABLE 24

MYOSTATIN INHIBITOR PEPTIDES

| Peptibody Name | Peptide |
|---|---|
| 2x mTN8-Con6-(N)-1K | M-GAQ-WYPCYEGHFWCYDL-GSGSATGGSGSTASSGSGSATG-WYPCYEGHFWCYDL-LE-5G-FC (SEQ ID NO: 1328) |
| 2x mTN8-Con6-(C)-1K | FC-5G-AQ-WYPCYEGHFWCYDL-GSGSATGGSGSTASSGSGSATG-WYPCYEGHFWCYDL-LE (SEQ ID NO: 1329) |
| 2x mTN8-Con7-(N)-1K | M-GAQ-IFGCKWWDVQCYQF-GSGSATGGSGSTASSGSGSATG-IFGCKWWDVQCYQF-LE-5G-FC (SEQ ID NO: 1330) |
| 2x mTN8-Con7-(C)-1K | FC-5G-AQ-IFGCKWWDVQCYQF-GSGSATGGSGSTASSGSGSATG-IFGCKWWDVQCYQF-LE (SEQ ID NO: 1331) |
| 2x mTN8-Con8-(N)-1K | M-GAQ-IFGCKWWDVDCYQF-GSGSATGGSGSTASSGSGSATG-IFGCKWWDVDCYQF-LE-5G-FC (SEQ ID NO: 1332) |
| 2x mTN8-Con8-(C)-1K | FC-5G-AQ-IFGCKWWDVDCYQF-GSGSATGGSGSTASSGSGSATG-IFGCKWWDVDCYQF-LE (SEQ ID NO: 1333) |
| 2X mTN8-19-7 | FC-5G-AQ-LADHGQCIRWPWMCPPEGWELEGSGSATGGSGSTASSGSGSATGLADHGQCIRWPWMCPPEGWE-LE (SEQ ID NO: 1334) |
| 2X mTN8-19-7 ST-GG del2x LE | FC-5G-AQ-LADHGQCIRWPWMCPPEGWEGSGSATGGSGGGASSGSGSATGLADHGQCIRWPWMCPPEGWE LE (SEQ ID NO: 1335) |
| 2X mTN8-19-21 | FC-5G-AQ-SEYQGLCTRWPWMCPPQGWKLEGSGSATGGSGSTASSGSGSATGSEYQGLCTRWPWMCPPQGWK-LE (SEQ ID NO: 1336) |
| 2X mTN8-19-21 ST-GG del2x LE | FC-5G-AQ-SEYQGLCTRWPWMCPPQGWKGSGSATGGSGGGASSGSGSATGSEYQGLCTRWPWMCPPQGWK LE (SEQ ID NO: 1337) |

TABLE 24-continued

MYOSTATIN INHIBITOR PEPTIDES

| Peptibody Name | Peptide |
|---|---|
| 2X mTN8-19-22 | FC-5G-AQ-TFSQGHCTRWPWMCPPQGWGLEGSGSA TGGSGSTASSGSGSATGTFSQGHCTRWPWMCPPQGW G-LE (SEQ ID NO: 1338) |
| 2X mTN8-19-32 | FC-5G-AQ-VADHGHCTRWPWMCPPQGWGLEGSGSA TGGSGSTASSGSGSATGVADHGHCTRWPWMCPPQGW G-LE (SEQ ID NO: 1339) |
| 2X mTN8-19-32 ST-GG del2x LE | FC-5G-AQ-VADHGHCTRWPWMCPPQGWGGSGSATG GSGGGASSGSGSATGVADHGHCTRWPWVCPPQGWG LE (SEQ ID NO: 1340) |
| 2X mTN8-19-33 | FC-5G-AQ-PESQGHCTRWIPWMCPPQGWGLEGSGS ATGGSGSTASSGSGSATGPESQGHCTRWPWMCPPQG WGLE (SEQ ID NO: 1341) |
| 2X mTN8-19-33 ST-GG del2x LE | FC-5G-AQ-PESQGHCTRWPWMCPPQGWGGSGSATG GSGGGASSGSGSATGPESQGHCTRWPWMCP PQGWG LE (SEQ ID NO: 1342) |

TABLE 25

Integrin-antagonist peptide sequences

| Sequence/structure | SEQ. ID NO: |
|---|---|
| CLCRGDCIC | 1344 |
| CWDDGWLC | 1345 |
| CWDDLWWLC | 1346 |
| CWDDGLMC | 1347 |
| CWDDGWMC | 1348 |
| CSWDDGWLC | 1349 |
| CPDDLWWLC | 1350 |
| NGR | 1351 |
| GSL | 1352 |
| RGD | 1353 |
| CGRECPRLCQSSC | 1354 |
| CNGRCVSGCAGRC | 1355 |
| CLSGSLSC | 1356 |
| GSL | 1357 |
| NGRAHA | 1358 |
| CNGRC | 1359 |
| CDCRGDCFC | 1360 |
| CGSLVRC | 1361 |
| DLXXL | 1362 |
| RTDLDSLRTYTL | 1363 |
| RTDLDSLRTY | 1364 |
| RTDLDSLRT | 1365 |
| RTDLDSLR | 1366 |
| GDLDLLKLRLTL | 1367 |
| GDLHSLRQLLSR | 1368 |
| RDDLHMLRLQLW | 1369 |
| SSDLHALKKRYG | 1370 |
| RGDLKQLSELTW | 1371 |
| CXXRGDC | 1372 |
| STGGFDDVYDWARGVSSALTTTLVATR | 1373 |
| STGGFDDVYDWARRVSSALTTTLVATR | 1374 |
| SRGVNFSEWLYDMSAAMKEASNVFPSRRSR | 1375 |
| SSQNWDMEAGVEDLTAAMLGLLSTIHSSR | 1376 |
| SSPSLYTQFLVNYESAATRIQDLLIASRPSR | 1377 |
| SSTGWVDLLGALQRAADATRTSIPPSLQNSR | 1378 |
| DVYTKKELIECARRVSEK | 1379 |
| RGDGX | 1380 |
| CRGDGXC | 1381 |
| CARRLDAPC | 1382 |
| CPSRLDSPC | 1383 |
| CDCRGDCFC | 1384 |
| CDCRGDCLC | 1385 |
| RGDLAALSAPPV | 1386 |

TABLE 26

Selectin antagonist peptide sequences

| Sequence/structure | SEQ. ID NO: |
|---|---|
| DITWDQLWDLMK | 1387 |
| DITWDELWKIMN | 1388 |
| DYTWFELWDMMQ | 1389 |
| QITWAQLWNMMK | 1390 |
| DMTWHDLWTLMS | 1391 |
| DYSWHDLWEMMS | 1392 |
| EITWDQLWEVMN | 1393 |
| HVSWEQLWDIMN | 1394 |
| HITWDQLWRIMT | 1395 |
| RNMSWLELWEHMK | 1396 |

TABLE 26-continued

Selectin antagonist peptide sequences

| Sequence/structure | SEQ. ID NO: |
|---|---|
| AEWTWDQLWHVMNPAESQ | 1397 |
| HRAEWLALWEQMSP | 1398 |
| KKEDWLALWRIMSV | 1399 |
| ITWDQLWDLMK | 1400 |
| DITWDQLWDLMK | 1401 |
| DITWDQLWDLMK | 1402 |
| DITWDQLWDLMK | 1403 |
| CQNRYTDLVAIQNKNE | 1404 |
| AENWADNEPNNKRNNED | 1405 |
| RKNNKTWTWVGTKKALTNE | 1406 |
| KKALTNEAENWAD | 1407 |
| CQXRYTDLVAIQNKXE | 1408 |
| AENWADGEPNNKXNXED | 1409 |

TABLE 27

Vinculin binding peptides

| Sequence/structure | SEQ. ID NO: |
|---|---|
| SSQNWDMEAGVEDLTAAMLGLLSTIHSSSR | 1410 |
| SSPSLYTQFLVNYESAATRIQDLLLASRPSR | 1411 |
| SSTGWVDLLGALQRAADATRTSIPPSLQNSR | 1412 |
| DVYTKKELIECARRVSEK | 1413 |
| STGGFDDVYDWARGVSSALTTTLVATR | 1414 |
| STGGFDDVYDWARRVSSALTTTLVATR | 1415 |
| SRGVNFSEWLYDMSAAMKEASNVFPSRRSR | 1416 |

TABLE 28

Laminin-related peptide sequences

| Sequence/structure | SEQ. ID NO: |
|---|---|
| YIGSRYIGSR [i.e., (YIGSR)₂] | 1417 |
| YLGSRYIGSRYIGSR [i.e., (YIGSR)₃] | 1418 |
| YIGSRYIGSRYIGSRYIGSR [i.e., (YIGSR)₄] | 1419 |
| YIGSRYIGSRYIGSRYIGSRYIGSR [i.e., (YIGSR)₅] | 1420 |
| IPCNNKGAHSVGLMWWMLAR | 1421 |
| YIGSRREDVEILDVPDSGR | 1422 |

TABLE 28-continued

Laminin-related peptide sequences

| Sequence/structure | SEQ. ID NO: |
|---|---|
| RGDRGDYIGSRRGD | 1423 |
| YIGSRYIGSRYIGSRYIGSRYIGSR | 1424 |
| REDVEILDVYIGSRPDSGR | 1425 |
| YIGSRREDVEILDVPDSGR | 1426 |

TABLE 29

NGF Modulating Peptides

| SEQ ID NO: | Sequence of Peptide Portion of Fc-Peptide Fusion Product |
|---|---|
| 1427 | TGYTEYTEEWPMGFGYQWSF |
| 1428 | TDWLSDFPFYEQYFGLMPPG |
| 1429 | FMRFPNPWKLVEPPQGWYYG |
| 1430 | VVKAPHFEFLAPPHFHEFPF |
| 1431 | FSYIWIDETPSNIDRYMLWL |
| 1432 | VNFPKVPEDVEPWPWSLKLY |
| 1433 | TWHPKTYEEFALPFFVPEAP |
| 1434 | WHFGTPYIQQQPGVYWLQAP |
| 1435 | VWNYGPFFMNFPDSTYFLHE |
| 1436 | WRIHSKPLDYSHVWFFPADF |
| 1437 | FWDGNQPPDILVDWPWNPPV |
| 1438 | FYSLEWLKDHSEFFQTVTEW |
| 1439 | QFMELLKFFNSPGDSSHHFL |
| 1440 | TNVDWISNNWEHMKSFFTED |
| 1441 | PNEKPYQMQSWFPPDWPVPY |
| 1442 | WSHTEWVPQVWWKPPNHFYV |
| 1443 | WGEWINDAQVHMHEGFISES |
| 1444 | VPWEHDHDLWEIISQDWHIA |
| 1445 | VLHLQDPRGWSNFPPGVLEL |
| 1446 | IHGCWFTEEGCVWQ |
| 1447 | YMQCQFARDGCPQW |
| 1448 | KLQCQYSESGCPTI |
| 1449 | FLQCEISGGACPAP |
| 1450 | KLQCEFSTSGCPDL |
| 1451 | KLQCEFSTQGCPDL |
| 1452 | KLQCEFSTSGCPWL |

TABLE 29-continued

NGF Modulating Peptides

| SEQ ID NO: | Sequence of Peptide Portion of Fc-Peptide Fusion Product |
|---|---|
| 1453 | IQGCWFTEEGCPWQ |
| 1454 | SFDCDNPWGHVLQSCFGF |
| 1455 | SFDCDNPWGHKLQSCFGF |

TABLE 30

TALL MODULATING PEPTIDES

| Sequence/structure | SEQ ID NO: |
|---|---|
| LPGCKWDLLIKQWVCDPL-Λ-V¹ | 1456 |
| V¹-Λ-LPGCKWDLLIKQWVCDPL | 1457 |
| LPGCKWDLLIKQWVCDPL-Λ-LPGCKWDLLIKQWVCDPL-Λ-V¹ | 1458 |
| V¹-Λ-LPGCKWDLLIKQWVCDPL-Λ-LPGCKWDLLLKQWVCDPL | 1459 |
| SADCYFDILTKSDVCTSS-Λ-V¹ | 1460 |
| V¹-Λ-SADCYFDILTKSDVCTSS | 1461 |
| SADCYFDILTKSDVTSS-Λ-SADCYFDILTKSDVTSS-Λ-V¹ | 1462 |
| V¹-Λ-SADCYFDILTKSDVTSS-Λ-SADCYFDILTKSDVTSS | 1463 |
| FHDCKWDLLTKQWVCHGL-Λ-V¹ | 1464 |
| V¹-Λ-FHDCKWDLLTKQWVCHGL | 1465 |
| FHDCKWDLLTKQWVCHGL-Λ-FHDCKWDLLTKQWVCHGL-Λ-V¹ | 1466 |
| V¹-Λ-FHDCKWDLLTKQWVCHGL-Λ-FHDCKWDLLTKQWVCHGL | 1467 |

TABLE 31

TALL-1 inhibitory peptibodies.

| Peptibody | Peptibody SEQ ID NO | Peptide Sequence |
|---|---|---|
| TALL-1-8-1-a | 1468 | MPGTCFPFPW ECTHAGGGGG VDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| TALL-1-8-2-a | 1469 | MWGACWPFPW ECFKEGGGGG VDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| TALL-1-8-4-a | 1470 | MVPFCDLLTK HCFEAGGGGG VDKTHTCPPC PAPELLGGPS VFLFPPKPKD TLMISRTPEV TCVVVDVSHE DPEVKFNWYV DGVEVHNAKT KPREEQYNST YRVVSVLTVL HQDWLNGKEY KCKVSNKALP APIEKTISKA KGQPREPQVY TLPPSRDELT KNQVSLTCLV KGFYPSDIAV EWESNGQPEN NYKTTPPVLD SDGSFFLYSK LTVDKSRWQQ GNVFSCSVMH EALHNHYTQK SLSLSPGK |
| TALL-1-12-4-a | 1471 | MGSRCKYKWD VLTKQCFHHG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-3-a | 1472 | MLPGCKWDLL IKQWVCDPLG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-5-a | 1473 | MSADCYFDIL TKSDVCTSSG GGGG VDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-8-a | 1474 | MSDDCMYDQL TRMFICSNLG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-9-a | 1475 | MDLNCKYDEL TYKEWCQFNG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |

TABLE 31-continued

TALL-1 inhibitory peptibodies.

| Peptibody | Peptibody SEQ ID NO | Peptide Sequence |
|---|---|---|
| TALL-1-12-10-a | 1476 | MFHDCKYDLL TRQMVCHGLG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-11-a | 1477 | MRNHCFWDHL LKQDICPSPG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-12-14-a | 1478 | MANQCWWDSL TKKNVCEFFG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1-consensus | 1479 | MFHDCKWDLL TKQWVCHGLG GGGGVDKTHT CPPCPAPELL GGPSVFLFPP KPKDTLMISR TPEVTCVVVD VSHEDPEVKF NWYVDGVEVH NAKTKPREEQ YNSTYRVVSV LTVLHQDWLN GKEYKCKVSN KALPAPIEKT ISKAKGQPRE PQVYTLPPSR DELTKNQVSL TCLVKGFYPS DIAVEWESNG QPENNYKTTP PVLDSDGSFF LYSKLTVDKS RWQQGNVFSC SVMHEALHNH YTQKSLSLSP GK |
| TALL-1 12-3 tandem dimer | 1480 | MLPGCKWDLL IKQWVCDPLG SGSATGGSGS TASSGSGSAT HMLPGCKWDL LIKQWVCDPL GGGGGVDKTH TCPPCPAPEL LGGPSVFLFP PKPKDTLMIS RTPEVTCVVV DVSHEDPEVK FNWYVDGVEV HNAKTKPREE QYNSTYRVYS VLTVLHQDWL NGKEYKCKVS NKALPAPIEK TISKAKGQPR EPQVYTLPPS RDELTKNQVS LTCLVKGFYP SDIAVEWESN GQPENNYKTT PPVLDSDGSF FLYSKLTVDK SRWQQGNVFS CSVMHEALHN HYTQKSLSLS PGK |
| TALL-1 consensus tandem dimer | 1481 | MFHDCKWDLL TKQWVCHGLG SGSATGGSGS TASSGSGSAT HMFHDCKWDL LTKQWVCHGL GGGGGVDKTH TCPPCPAPEL LGGPSVFLFP PKPKDTLMIS RTPEVTCVVV DVSHEDPEVK FNWYVDGVEV HNAKTKPREE QYNSTYRVVS VLTVLHQDWL NGKEYKCKVS NKALPAPIEK TISKAKGQPR EPQVYTLPPS RDELTKNQVS LTCLVKGFYP SDIAVEWESN GQPENNYKTT PPVLDSDGSF FLYSKLTVDK SRWQQGNVFS CSVMHEALHN HYTQKSLSLS PGK |

TABLE 32

ANG-2 INHIBITOR PEPTIDES

| PEPTIDE | SEQ ID NO. | PEPTIDE SEQUENCE |
|---|---|---|
| Con4-44 | 1482 | PIRQEECDWDPWTCEHMWEV |
| Con4-40 | 1483 | TNIQEECEWDPWTCDHMPGK |
| Con4-4 | 1484 | WYEQDACEWDPWTCEHMAEV |
| Con4-31 | 1485 | NRLQEVCEWDPWTCEHMENV |
| Con4-C5 | 1486 | AATQEECEWDPWTCEHMPRS |
| Con4-42 | 1487 | LRHQEGCEWDPWTCEHMFDW |
| Con4-35 | 1488 | VPRQKDCEWDPWTCEHMYVG |
| Con4-43 | 1489 | SISHEECEWDPWTCEHMQVG |
| Con4-49 | 1490 | WAAQEECEWDPWTCEHMGRM |
| Con4-27 | 1491 | TWPQDKCEWDPWTCEHMGST |
| Con4-48 | 1492 | GHSQEECGWDPWTCEHMGTS |
| Con4-46 | 1493 | QHWQEECEWDPWTCDHMPSK |
| Con4-41 | 1494 | NVRQEKCEWDPWTCEHMPVR |
| Con4-36 | 1495 | KSGQVECNWDPWTCEHMPRN |
| Con4-34 | 1496 | VKTQEHCDWDPWTCEHMREW |
| Con4-28 | 1497 | AWGQEGCDWDPWTCEHMLPM |
| Con4-39 | 1498 | PVNQEDCEWDPWTCEHMPPM |
| Con4-25 | 1499 | RAPQEDCEWDPWTCAHMDIK |
| Con4-50 | 1500 | HGQNMECEWDPWTCEHMFRY |
| Con4-38 | 1501 | PRLQEECVWDPWTCEHMPLR |
| Con4-29 | 1502 | RTTQEKCEWDPWTCEHMESQ |
| Con4-47 | 1503 | QTSQEDCVWDPWTCDHMVSS |
| Con4-20 | 1504 | QVIGRPCEWDPWTCEHLEGL |
| Con4-45 | 1505 | WAQQEECAWDPWTCDHMVGL |
| Con4-37 | 1506 | LPGQEDCEWDPWTCEHMVRS |
| Con4-33 | 1507 | PMNQVECDWDPWTCEHMPRS |
| AC2-Con4 | 1508 | FGWSHGCEWDPWTCEHMGST |
| Con4-32 | 1509 | KSTQDDCDWDPWTCEHMVGP |
| Con4-17 | 1510 | GPRISTCQWDPWTCEHMDQL |
| Con4-8 | 1511 | STIGDMCEWDPWTCAHMQVD |
| AC4-Con4 | 1512 | VLGGQGCEWDPWTCRLLQGW |
| Con4-1 | 1513 | VLGGQGCQWDPWTCSHLEDG |
| Con4-C1 | 1514 | TTIGSMCEWDPWTCAHMQGG |
| Con4-21 | 1515 | TKGKSVCQWDPWTCSHMQSG |
| Con4-C2 | 1516 | TTIGSMCQWDPWTCAHMQGG |
| Con4-18 | 1517 | WVNEVVCEWDPWTCNHWDTP |
| Con4-19 | 1518 | VVQVGMCQWDPWTCKHMRLQ |
| Con4-16 | 1519 | AVGSQTCEWDPWTCAHLVEV |

TABLE 32-continued

ANG-2 INHIBITOR PEPTIDES

| PEPTIDE | SEQ ID NO. | PEPTIDE SEQUENCE |
|---|---|---|
| Con4-11 | 1520 | QGMKMFCEWDPWTCAHIVYR |
| Con4-C4 | 1521 | TTIGSMCQWDPWTCEHMQGG |
| Con4-23 | 1522 | TSQRVGCEWDPWTCQHLTYT |
| Con4-15 | 1523 | QWSWPPCEWDPWTCQTVWPS |
| Con4-9 | 1524 | GTSPSFCQWDPWTCSHMVQG |
| TN8-Con4* | 1525 | QEECEWDPWTCEHM |

TABLE 33

ANG-2 INHIBITOR PEPTIDES

| Peptide | SEQ ID NO. | Peptide Sequence |
|---|---|---|
| L1-1 | 1526 | QNYKPLDELDATLYEHFIFHYT |
| L1-2 | 1527 | LNFTPLDELEQTLYEQWTLQQS |
| L1-3 | 1528 | TKFNPLDELEQTLYEQWTLQHQ |
| L1-4 | 1529 | VKFKPLDALEQTLYEHWMFQQA |
| L1-5 | 1530 | VKYKPLDELDEILYEQQTFQER |
| L1-7 | 1531 | TNFMPMDDLEQRLYEQFILQQG |
| L1-9 | 1532 | SKFKPLDELEQTLYEQWTLQHA |
| L1-10 | 1533 | QKFQPLDELEQTLYEQFMLQQA |
| L1-11 | 1534 | QNFKPMDELEDTLYKQFLFQHS |
| L1-12 | 1535 | YKFTPLDDLEQTLYEQWTLQHV |
| L1-13 | 1536 | QEYEPLDELDETLYNQWMFHQR |
| L1-14 | 1537 | SNFMPLDELEQTLYEQFMLQHQ |
| L1-15 | 1538 | QKYQPLDELDKTLYDQFMLQQG |
| L1-16 | 1539 | QKFQPLDELEETLYKQWTLQQR |
| L1-17 | 1540 | VKYKPLDELDEWLYHQFTLHHQ |
| L1-18 | 1541 | QKFMPLDELDEILYEQFMFQQS |
| L1-19 | 1542 | QTFQPLDDLEEYLYEQWIRRYH |
| L1-20 | 1543 | EDYMPLDALDAQLYEQFILLHG |
| L1-21 | 1544 | HTFQPLDELEETLYYQWLYDQL |
| L1-22 | 1545 | YKFNPMDELEQTLYEEFLFQHA |
| AC6-L1 | 1546 | TNYKPLDELDATLYEHWILQHS |
| L1-C1 | 1547 | QKFKPLDELEQTLYEQWTLQQR |
| L1-C2 | 1548 | TKFQPLDELDQTLYEQWTLQQR |
| L1-C3 | 1549 | TNFQPLDELDQTLYEQWTLQQR |
| L1 | 1550 | KFNPLDELEETLYEQFTFQQ |

TABLE 34

ANG-2 INHIBITOR PEPTIDES

| Peptide | SEQ ID NO. | Sequence |
|---|---|---|
| Con1-1 | 1551 | AGGMRPYDGMLGWPNYDVQA |
| Con1-2 | 1552 | QTWDDPCMHILGPVTWRRCI |
| Con1-3 | 1553 | APGQRPYDGMLGWPTYQRIV |
| Con1-4 | 1554 | SGQLRPCEEIFGCGTQNLAL |
| Con1-5 | 1555 | FGDKRPLECMFGGPIQLCPR |
| Con1-6 | 1556 | GQDLRPCEDMFGCGTKDWYG |
| Con1 | 1557 | KRPCEEIFGGCTYQ |

TABLE 35

ANG-2 INHIBITOR PEPTIDES

| Peptide | SEQ ID NO: | Sequence |
|---|---|---|
| 12-9-1 | 1558 | GFEYCDGMEDPFTFGCDKQT |
| 12-9-2 | 1559 | KLEYCDGMEDPFTQGCDNQS |
| 12-9-3 | 1560 | LQEWCEGVEDPFTFGCEKQR |
| 12-9-4 | 1561 | AQDYCEGMEDPFTFGCEMQK |
| 12-9-5 | 1562 | LLDYCEGVQDPFTFGCENLD |
| 12-9-6 | 1563 | HQEYCEGMEDPFTFGCEYQG |
| 12-9-7 | 1564 | MLDYCEGMDDPFTFGCDKQM |
| 12-9-C2 | 1565 | LQDYCEGVEDPFTFGCENQR |
| 12-9-C1 | 1566 | LQDYCEGVEDPFTFGCEKQR |
| 12-9 | 1567 | FDYCEGVEDPFTFGCDNH |

TABLE 36

Ang-2 Binding Peptides

| Peptide | Seq Id No. | Sequence |
|---|---|---|
| TN8-8 | 1568 | KRPCEEMWGGCNYD |
| TN8-14 | 1569 | HQICKWDPWTCKHW |
| TN8-Con1 | 1570 | KRPCEEIFGGCTYQ |
| TN8-Con4 | 1571 | QEECEWDPWTCEHM |
| TN12-9 | 1572 | FDYCEGVEDPFTFGCDNH |
| L1 | 1573 | KFNPLDELEETLYEQFTFQQ |
| C17 | 1574 | QYGCDGFLYGCMIN |

TABLE 37

Ang-2 Binding Peptides

| Peptibody | Peptibody Sequence |
|---|---|
| L1 (N) | MGAQKFNPLDELEETLYEQFTFQQLEGGGGG-Fc (SEQ ID NO: 1575) |
| L1 (N) WT | MKFNPLDELEETLYEQFTFQQLEGGGGG-Fc (SEQ ID NO: 1576) |
| L1 (N) 1K WT | MKFNPLDELEETLYEQFTFQQGSGSATGGSGSTASSGSGSATHLEGGGGG-Fc (SEQ ID NO: 1577) |
| 2xL1 (N) | MGAQKFNPLDELEETLYEQFTFQQGGGGGGGGGKFNPLDELEETLYEQFTFQQLEGGGGG-Fc (SEQ ID NO: 1578) |
| 2xL1 (N) WT | MKFNPLDELEETLYEQFTFQQGGGGGGGGGKFNPLDELEETLYEQFTFQQLEGGGGG-Fc (SEQ ID NO: 1579) |
| Con4 (N) | MGAQQEECEWDPWTCEHMLEGGGGG-Fc (SEQ ID NO: 1580) |
| Con4 (N) 1K-WT | MQEEGEWDPWTCEHMGSGSATGGSGSTASSGSGSATHLEGGGGG-Fc (SEQ ID NO: 1581) |
| 2xCon4 (N) 1K | MGAQQEECEWDPWTCEHMGSGSATGGSGSTASSGSGSATHQEECEWDPWTCEHMLEGGGGG-Fc (SEQ ID NO: 1582) |
| L1 (C) | M-Fc-GGGGGAQKFNPLDELEETLYEQFTFQQLE (SEQ ID NO: 1583) |
| L1 (C) 1K | M-Fc-GGGGGAQGSGSATGGSGSTASSGSGSATHKFNPLDELEETLYEQFTFQQLE (SEQ ID NO: 1584) |
| 2xL1 (C) | M-Fc-GGGGGAQKFNPLDELEETLYEQFTFQQGGGGGGGGGKFNPLDELEETLYEQFTFQQLE (SEQ ID NO: 1585) |
| Con4 (C) | M-Fc-GGGGGAQQEECEWDPWTCEHMLE (SEQ ID NO: 1586) |
| Con4 (C) 1K | M-Fc-GGGGGAQGSGSATGGSGSTASSGSGSATHQEECEWDPWTCEHMLE (SEQ ID NO: 1587) |
| 2xCon4 (C) 1K | M-Fc-GGGGGAQQEECEWDPWTCEHMGSGSATGGSGSTASSGSGSATHQEECEWDPWTCEHMLE (SEQ ID NO: 1588) |
| Con4-L1 (N) | MGAQEECEWDPWTCEHMGGGGGGGGGKFNPLDELEETLYEQFTFQQGSGSATGGSGSTASSGSGSATHLEGGGGG-Fc (SEQ ID NO: 1589) |
| Con4-L1 (C) | M-Fc-GGGGGAQGSGSATGGSGSTASSGSGSATHKFNPLDELEETLYEQFTFQQGGGGGQEECEWDPWTCEHMLE (SEQ ID NO: 1590) |
| TN-12-9 (N) | MGAQ-FDYCEGVEDPFTFGCDNHLE-GGGGG-Fc (SEQ ID NO: 1591) |
| C17 (N) | MGAQ-QYGCDGFLYGCMINLE-GGGGG-Fc (SEQ ID NO: 1592) |
| TN8-8 (N) | MGAQ-KRPCEEMWGGCNYDLEGGGGG-Fc (SEQ ID NO: 1593) |
| TN8-14 (N) | MGAQ-HQICKWDPWTCKHWLEGGGGG-Fc (SEQ ID NO: 1594) |
| Con1 (N) | MGAQ-KRPCEEIFGGCTYQLEGGGGG-Fc (SEQ ID NO: 1595) |

TABLE 38

Ang-2 Binding Peptides

| Con4 Derived Affinity-Matured Pbs | Peptibody Sequence (Seq Id No:) |
|---|---|
| Con4-44 (C) | M-Fc-GGGGGAQ-PIRQEECDWDPWTCEHMWEV-LE (SEQ ID NO: 1596) |
| Con4-40 (C) | M-Fc-GGGGGAQ-TNIQEECEWDPWTCDHMPGK-LE (SEQ ID NO: 1597) |
| Con4-4 (C) | M-Fc-GGGGGAQ-WYEQDACEWDPWTCEHMAEV-LE (SEQ ID NO: 1598) |
| Con4-31 (C) | M-Fc-GGGGGAQ-NRLQEVCEWDPWTCEHMENV-LE (SEQ ID NO: 1599) |
| Con4-C5 (C) | M-Fc-GGGGGAQ-AATQEECEWDPWTCEHMPRS-LE (SEQ ID NO: 1600) |
| Con4-42 (C) | M-Fc-GGGGGAQ-LRHQEGCEWDPWTCEHMFDW-LE (SEQ ID NO: 1602) |
| Con4-35 (C) | M-Fc-GGGGGAQ-VPRQKDCEWDPWTCEHMYVG-LE (SEQ ID NO: 1602) |
| Con4-43 (C) | M-Fc-GGGGGAQ-SISHEECEWDPWTCEHMQVG-LE (SEQ ID NO: 1603) |
| Con4-49 (C) | M-Fc-GGGGGAQ-WAAQEECEWDPWTCEHMGRM-LE (SEQ ID NO: 1604) |
| Con4-27 (C) | M-Fc-GGGGGAQ-TWPQDKCEWDPWTCEHMGST-LE (SEQ ID NO: 1605) |
| Con4-48 (C) | M-Fc-GGGGGAQ-GHSQEECGWDPWTCEHMGTS-LE (SEQ ID NO: 1606) |
| Con4-46 (C) | M-Fc-GGGGGAQ-QHWQEECEWDPWTCDHMPSK-LE (SEQ ID NO: 1607) |
| Con4-41 (C) | M-Fc-GGGGGAQ-NVRQEKCEWDPWTCEHMPVR-LE (SEQ ID NO: 1608) |
| Con4-36 (C) | M-Fc-GGGGGAQ-KSGQVECNWDPWTCEHMPRN-LE (SEQ ID NO: 1609) |
| Con4-34 (C) | M-Fc-GGGGGAQ-VKTQEHCDWDPWTCEHMREW-LE (SEQ ID NO: 1610) |
| Con4-28 (C) | M-Fc-GGGGGAQ-AWGQEGCDWDPWTCEHMLPM-LE (SEQ ID NO: 1611) |
| Con4-39 (C) | M-Fc-GGGGGAQ-PVNQEDCEWDPWTCEHMPPM-LE (SEQ ID NO: 1612) |
| Con4-25 (C) | M-Fc-GGGGGAQ-RAPQEDCEWDPWTCAHMDIK-LE (SEQ ID NO: 1613) |
| Con4-50 (C) | M-Fc-GGGGGAQ-HGQNMECEWDPWTCEHMFRY-LE (SEQ ID NO: 1614) |
| Con4-38 (C) | M-Fc-GGGGGAQ-PRLQEECVWDPWTCEHMPLR-LE (SEQ ID NO: 1615) |
| Con4-29 (C) | M-Fc-GGGGGAQ-RTTQEKCEWDPWTCEHMESQ-LE (SEQ ID NO: 1616) |
| Con4-47 (C) | M-Fc-GGGGGAQ-QTSQEDCVWDPWTCDHMVSS-LE (SEQ ID NO: 1617) |
| Con4-20 (C) | M-Fc-GGGGGAQ-QVIGRPCEWDPWTCEHLEGL-LE (SEQ ID NO: 1618) |
| Con4-45 (C) | M-Fc-GGGGGAQ-WAQQEECAWDPWTCDHMVGL-LE (SEQ ID NO: 1619) |

TABLE 38-continued

Ang-2 Binding Peptides

| | | |
|---|---|---|
| Con4-37 (C) | M-Fc-GGGGGAQ-LPGQEDCEWDPWTCEHMVRS-LE (SEQ ID NO: 1620) | |
| Con4-33 (C) | M-Fc-GGGGGAQ-PMNQVECDWDPWTCEHMPRS-LE (SEQ ID NO: 1621) | |
| AC2-Con4 (C) | M-Fc-GGGGGAQ-FGWSHGCEWDPWTCEHMGST-LE (SEQ ID NO: 1622) | |
| Con4-32 (C) | M-Fc-GGGGGAQ-KSTQDDCDWDPWTCEHMVGP-LE (SEQ ID NO: 1623) | |
| Con4-17 (C) | M-Fc-GGGGGAQ-GPRISTCQWDPWTCEHMDQL-LE (SEQ ID NO: 1624) | |
| Con4-8 (C) | M-Fc-GGGGGAQ-STIGDMCEWDPWTCAHMQVD-LE (SEQ ID NO: 1625) | |
| AC4-Con4 (C) | M-Fc-GGGGGAQ-VLGGQGCEWDPWTCRLLQGW-LE (SEQ ID NO: 1626) | |
| Con4-1 (C) | M-Fc-GGGGGAQ-VLGGQGCQWDPWTCSHLEDG-LE (SEQ ID NO: 1627) | |
| Con4-C1 (C) | M-Fc-GGGGGAQ-TTIGSMCEWDPWTCAHMQGG-LE (SEQ ID NO: 1628) | |
| Con4-21 (C) | M-Fc-GGGGGAQ-TKGKSVCQWDPWTCSHMQSG-LE (SEQ ID NO: 1629) | |
| Con4-C2 (C) | M-Fc-GGGGGAQ-TTIGSMCQWDPWTCAHMQGG-LE (SEQ ID NO: 1630) | |
| Con4-18 (C) | M-Fc-GGGGGAQ-WVNEVVCEWDPWTCNHWDTP-LE (SEQ ID NO: 1631) | |
| Con4-19 (C) | M-Fc-GGGGGAQ-VVQVGMCQWDPWTCKHMRLQ-LE (SEQ ID NO: 1632) | |
| Con4-16 (C) | M-Fc-GGGGGAQ-AVGSQTCEWDPWTCAHLVEV-LE (SEQ ID NO: 1633) | |
| Con4-11 (C) | M-Fc-GGGGGAQ-QGMKMFCEWDPWTCAHIVYR-LE (SEQ ID NO: 1634) | |
| Con4-C4 (C) | M-Fc-GGGGGAQ-TTIGSMCQWDPWTCEHMQGG-LE (SEQ ID NO: 1635) | |
| Con4-23 (C) | M-Fc-GGGGGAQ-TSQRVGCEWDPWTCQHLTYT-LE (SEQ ID NO: 1636) | |
| Con4-15 (C) | M-Fc-GGGGGAQ-QWSWPPCEWDPWTCQTVWPS-LE (SEQ ID NO: 1637) | |
| Con4-9 (C) | M-Fc-GGGGGAQ-GTSPSFCQWDPWTCSHMVQG-LE (SEQ ID NO: 1638) | |
| Con4-10 (C) | M-Fc-GGGGGAQ-TQGLHQCEWDPWTCKVLWPS-LE (SEQ ID NO: 1639) | |
| Con4-22 (C) | M-Fc-GGGGGAQ-VWRSQVCQWDPWTCNLGGDW-LE (SEQ ID NO: 1640) | |
| Con4-3 (C) | M-Fc-GGGGGAQ-DKILEECQWDPWTCQFFYGA-LE (SEQ ID NO: 1641) | |
| Con4-5 (C) | M-Fc-GGGGGAQ-ATFARQCQWDPWTCALGGNW-LE (SEQ ID NO: 1642) | |
| Con4-30 (C) | M-Fc-GGGGGAQ-GPAQEECEWDPWTCEPLPLM-LE (SEQ ID NO: 1643) | |
| Con4-26 (C) | M-Fc-GGGGGAQ-RPEDMCSQWDPWTWHLQGYC-LE (SEQ ID NO: 1644) | |
| Con4-7 (C) | M-Fc-GGGGGAQ-LWQLAVCQWDPQTCDHMGAL-LE (SEQ ID NO: 1645) | |
| Con4-12 (C) | M-Fc-GGGGGAQ-TQLVSLCEWDPWTCRLLDGW-LE (SEQ ID NO: 1646) | |
| Con4-13 (C) | M-Fc-GGGGGAQ-MGGAGRCEWDPWTCQLLQGW-LE (SEQ ID NO: 1647) | |
| Con4-14 (C) | M-Fc-GGGGGAQ-MFLPNECQWDPWTCSNLPEA-LE (SEQ ID NO: 1648) | |
| Con4-2 (C) | M-Fc-GGGGGAQ-FGWSHGCEWDPWTCRLLQGW-LE (SEQ ID NO: 1649) | |
| Con4-6 (C) | M-Fc-GGGGGAQ-WPQTEGCQWDPWTCRLLHGW-LE (SEQ ID NO: 1650) | |
| Con4-24 (C) | M-Fc-GGGGGAQ-PDTRQGCQWDPWTCRLYGMW-LE (SEQ ID NO: 1651) | |
| AC1-Con4 (C) | M-Fc-GGGGGAQ-TWPQDKCEWDPWTCRLLQGW-LE (SEQ ID NO: 1652) | |
| AC3-Con4 (C) | M-Fc-GGGGGAQ-DKILEECEWDPWTCRLLQGW-LE (SEQ ID NO: 1653) | |
| AC5-Con4 (C) | M-Fc-GGGGGAQ-AATQEECEWDPWTCRLLQGW-LE (SEQ ID NO: 1654) | |

| L1 Derived Affinity-Matured Pbs | Peptibody Sequence (Seq Id No:) |
|---|---|
| L1-7 (N) | MGAQ-TNFMPMDDLEQRLYEQFILQQG-LEGGGGG-Fc (SEQ ID NO: 1655) |
| C6-L1 (N) | MGAQ-TNYKPLDELDATLYEHWILQHS LEGGGGG-Fc (SEQ ID NO: 1656) |
| L1-15 (N) | MGAQ-QKYQPLDELDKTLYDQFMLQQG LEGGGGG-Fc (SEQ ID NO: 1657) |
| L1-2 (N) | MGAQ-LNFTPLDELEQTLYEQWTLQQS LEGGGGG-Fc (SEQ ID NO: 1658) |
| L1-10 (N) | MGAQ-QKFQPLDELEQTLYEQFMLQQA LEGGGGG-Fc (SEQ ID NO: 1659) |
| L1-13 (N) | MGAQ-QEYEPLDELDETLYNQWMFHQR LEGGGGG-Fc (SEQ ID NO: 1660) |
| L1-5 (N) | MGAQ-VKYKPLDELDEILYEQQTFQER LEGGGGG-Fc (SEQ ID NO: 1661) |
| L1-C2 (N) | MGAQ-TKFQPLDELDQTLYEQWTLQQR LEGGGGG-Fc (SEQ ID NO: 1662) |
| L1-C3 (N) | MGAQ-TNFQPLDELDQTLYEQWTLQQR LEGGGGG-Fc (SEQ ID NO: 1663) |
| L1-11 (N) | MGAQ-QNFKPMDELEDTLYKQFLFQHS LEGGGGG-Fc (SEQ ID NO: 1664) |
| L1-17 (N) | MGAQ-VKYKPLDELDEWLYHQFTLHHQ LEGGGGG-Fc (SEQ ID NO: 1665) |
| L1-12 (N) | MGAQ-YKFTPLDDLEQTLYEQWTLQHV LEGGGGG-Fc (SEQ ID NO: 1666) |
| L1-1 (N) | MGAQ-QNYKPLDELDATLYEHFIFHYT LEGGGGG-Fc (SEQ ID NO: 1667) |
| L1-4 (N) | MGAQ-VKFKPLDALEQTLYEHWMFQQA LEGGGGG-Fc (SEQ ID NO: 1668) |
| L1-20 (N) | MGAQ-EDYMPLDALDAQLYEQFILLHG LEGGGGG-Fc (SEQ ID NO: 1669) |

TABLE 38-continued

Ang-2 Binding Peptides

| | | |
|---|---|---|
| L1-22 (N) | MGAQ-YKFNPMDELEQTLYEEFLFQHA LEGGGGG-Fc (SEQ ID NO: 1670) | |
| L1-14 (N) | MGAQ-SNFMPLDELEQTLYEQFMLQHQ LEGGGGG-Fc (SEQ ID NO: 1671) | |
| L1-16 (N) | MGAQ-QKFQPLDELEETLYKQWTLQQR LEGGGGG-Fc (SEQ ID NO: 1672) | |
| L1-18 (N) | MGAQ-QKFMPLDELDEILYEQFMFQQS LEGGGGG-Fc (SEQ ID NO: 1673) | |
| L1-3 (N) | MGAQ-TKFNPLDELEQTLYEQWTLQHQ LEGGGGG-Fc (SEQ ID NO: 1674) | |
| L1-21 (N) | MGAQ-HTFQPLDELEETLYYQWLYDQL LEGGGGG-Fc (SEQ ID NO: 1675) | |
| L1-C1 (N) | MGAQ-QKFKPLDELEQTLYEQWTLQQR LEGGGGG-Fc (SEQ ID NO: 1676) | |
| L1-19 (N) | MGAQ-QTFQPLDDLEEYLYEQWIRRYH LEGGGGG-Fc (SEQ ID NO: 1677) | |
| L1-9 (N) | MGAQ-SKFKLPLDELEQTLYEQWTLQHA LEGGGGG-Fc (SEQ ID NO: 1678) | |

| Con1 Derived Affinity-Matured Pbs | Peptibody Sequence (Seq Id No:) |
|---|---|
| Con1-4 (C) | M-Fc-GGGGGAQ-SGQLRPCEEIFGCGTQNLAL-LE (SEQ ID NO: 1679) |
| Con1-1 (C) | M-Fc-GGGGGAQ-AGGMRPYDGMLGWPNYDVQA-LE (SEQ ID NO: 1680) |
| Con1-6 (C) | M-Fc-GGGGGAQ-GQDLRPCEDMFGCGTKDWYG-LE (SEQ ID NO: 1681) |
| Con1-3 (C) | M-Fc-GGGGGAQ-APGQRPYDGMLGWPTYQRIV-LE (SEQ ID NO: 1682) |
| Con1-2 (C) | M-Fc-GGGGGAQ-QTWDDPCMHILGPVTWRRCI-LE (SEQ ID NO: 1683) |
| Con1-5 (C) | M-Fc-GGGGGAQ-FGDKRPLECMFGGPIQLCPR-LE (SEQ ID NO: 1684) |
| Parent: Con1 (C) | M-Fc-GGGGGAQ-KRPCEEIFGGCTYQ-LE (SEQ ID NO: 1685) |

| 12-9 Derived Affinity-Matured Pbs | Peptibody Sequence (Seq Id No:) |
|---|---|
| 12-9-3 (C) | M-Fc-GGGGGAQ-LQEWCEGVEDPFTFGCEKQR-LE (SEQ ID NO: 1686) |
| 12-9-7 (C) | M-Fc-GGGGGAQ-MLDYCEGMDDPFTFGCDKQM-LE (SEQ ID NO: 1687) |
| 12-9-6 (C) | M-Fc-GGGGGAQ-HQEYCEGMEDPFTFGCEYQG-LE (SEQ ID NO: 1688) |
| 12-9-C2 (C) | M-Fc-GGGGGAQ-LQDYCEGVEDPFTFGCENQR-LE (SEQ ID NO: 1689) |
| 12-9-5 (C) | M-Fc-GGGGGAQ-LLDYCEGVQDPFTFGCENLD-LE (SEQ ID NO: 1690) |
| 12-9-1 (C) | M-Fc-GGGGGAQ-GFEYCDGMEDPFTFGCDKQT-LE (SEQ ID NO: 1691) |
| 12-9-4 (C) | M-Fc-GGGGGAQ-AQDYCEGMEDPFTFGCEMQK-LE (SEQ ID NO: 1692) |
| 12-9-C1 (C) | M-Fc-GGGGGAQ-LQDYCEGVEDPFTFGCEKQR-LE (SEQ ID NO: 1693) |
| 12-9-2 (C) | M-Fc-GGGGGAQ-KLEYCDGMEDPFTQGCDNQS-LE (SEQ ID NO: 1694) |
| Parent: 12-9 (C) | M-Fc-GGGGGAQ-FDYCEGVEDPFTFGCDNH-LE (SEQ ID NO: 1695) |

In addition to the TMP compounds set out in Table 6, the invention provides numerous other TMP compounds. In one aspect, TMP compounds comprise the following general structure:

$$TMP_1\text{-}(L_1)_n\text{-}TMP_2$$

wherein $TMP_1$ and $TMP_2$ are each independently selected from the group of compounds comprising the core structure:

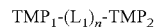

wherein,
$X_2$ is selected from the group consisting of Glu, Asp, Lys, and Val;
$X_3$ is selected from the group consisting of Gly and Ala;
$X_4$ is Pro;
$X_5$ is selected from the group consisting of Thr and Ser;
$X_6$ is selected from the group consisting of Leu, Ile, Val, Ala, and Phe;
$X_7$ is selected from the group consisting of Arg and Lys;
$X_8$ is selected from the group consisting of Gln, Asn, and Glu;
$X_9$ is selected from the group consisting of Trp, Tyr, and Phe;
$X_{10}$ is selected from the group consisting of Leu, Ile, Val, Ala, Phe, Met, and Lys;
$L_1$ is a linker as described herein; and
n is 0 or 1;
and physiologically acceptable salts thereof.

In one embodiment, $L_1$ comprises $(Gly)_n$, wherein n is 1 through 20, and when n is greater than 1, up to half of the Gly residues may be substituted by another amino acid selected from the remaining 19 natural amino acids or a stereoisomer thereof.

In addition to the core structure $X_2$-$X_{10}$ set forth above for $TMP_1$ and $TMP_2$, other related structures are also possible wherein one or more of the following is added to the $TMP_1$ and/or $TMP_2$ core structure: $X_1$ is attached to the N-terminus and/or $X_{11}$, $X_{12}$, $X_{13}$, and/or $X_{14}$ are attached to the C-terminus, wherein $X_1$, $X_{12}$, $X_{13}$, and $X_{14}$ are as follows:

$X_1$ is selected from the group consisting of Ile, Ala, Val, Leu, Ser, and Arg;
$X_{11}$ is selected from the group consisting of Ala, Ile, Val, Leu, Phe, Ser, Thr, Lys, His, and Glu;
$X_{12}$ is selected from the group consisting of Ala, Ile, Val, Leu, Phe, Gly, Ser, and Gln;
$X_{13}$ is selected from the group consisting of Arg, Lys, Thr, Val, Asn, Gln, and Gly; and
$X_{14}$ is selected from the group consisting of Ala, Ile, Val, Leu, Phe, Thr, Arg, Glu, and Gly.

TMP compounds of the invention are made up of, i.e., comprising, at least 9 subunits ($X_2$-$X_{10}$), wherein $X_2$-$X_{10}$ comprise the core structure. The $X_2$-$X_{14}$ subunits are amino acids independently selected from among the 20 naturally-occurring amino acids, however, the invention embraces compounds where $X_2$-$X_{14}$ are independently selected from the group of atypical, non-naturally occurring amino acids well known in the art. Specific amino acids are identified for each position. For example, $X_2$ may be Glu, Asp, Lys, or Val. Both three-letter and single letter abbreviations for amino acids are used herein; in each case, the abbreviations are the standard ones used for the 20 naturally-occurring amino acids or well-known variations thereof. These amino acids may have either L or D stereochemistry (except for Gly, which is neither L nor D), and the TMPs (as well as all other compounds of the invention) may comprise a combination of stereochemistries. The invention also provides reverse TMP molecules (as well as for all other peptides disclosed herein) wherein the amino terminal to carboxy terminal sequence of the amino acids is reversed. For example, the reverse of a molecule having the normal sequence $X_{11}X_2$-$X_3$ would be $X_3$-$X_2$-$X_1$. The invention also provides retro-reverse TMP molecules (as well as for all other molecules of the invention described herein) wherein, like a reverse TMP, the amino terminal to carboxy terminal sequence of amino acids is reversed and residues that are normally "L" enantiomers in TMP are altered to the "D" stereoisomer form.

Exemplary TMP compounds of the invention therefore include without limitation the following compounds:

Derivatives

The invention also contemplates derivatizing the peptide and/or vehicle portion (as discussed below) of the compounds. Such derivatives may improve the solubility, absorption, biological half life, and the like of the compounds. The moieties may alternatively eliminate or attenuate any undesirable side-effect of the compounds and the like. Exemplary derivatives include compounds in which:

1. The compound or some portion thereof is cyclic. For example, the peptide portion may be modified to contain two or more Cys residues (e.g., in the linker), which could cyclize by disulfide bond formation. For citations to references on preparation of cyclized derivatives, see Table 2.

2. The compound is cross-linked or is rendered capable of cross-linking between molecules. For example, the peptide portion may be modified to contain one Cys residue and thereby be able to form an intermolecular disulfide bond with a like molecule. The compound may also be cross-linked through its C-terminus, as in the molecule shown below.

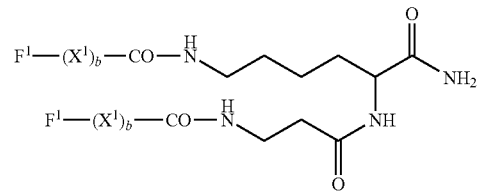

| | |
|---|---|
| IEGPTLRQWLAARA-GPNG-IEGPTLRQWLAARA | (SEQ. ID NO: 993) |
| IEGPTLRQCLAARA-GGGGGGGG-IEGPTLRQCLAARA (cyclic) | (SEQ. ID NO: 994) |
| IEGPTLRQCLAARA-GGGGGGGG-IEGPTLRQCLAARA (linear) | (SEQ. ID NO: 995) |
| IEGPTLRQALAARA-GGGGGGGG-IEGPTLRQALAARA | (SEQ. ID NO: 996) |
| IEGPTLRQWLAARA-GGGKGGGG-IEGPTLRQWLAARA | (SEQ. ID NO: 997) |
| IEGPTLRQWLAARA-GGGK(BrAc)GGGG-IEGPTLRQWLAARA | (SEQ. ID NO: 998) |
| IEGPTLRQWLAARA-GGGCGGGG-IEGPTLRQWLAARA | (SEQ. ID NO: 999) |
| IEGPTLRQWLAARA-GGGK(PEG)GGGG-IEGPTLRQWLAARA | (SEQ. ID NO: 1000) |
| IEGPTLRQWLAARA-GGGC(PEG)GGGG-IEGPTLRQWLAARA | (SEQ. ID NO: 1001) |
| IEGPTLRQWLAARA-GGGNGSGG-IEGPTLRQWLAARA | (SEQ. ID NO: 1002) |
| IEGPTLRQWLAARA-GGGCGGGG-IEGPTLRQWLAARA<br>                                                                                                      \|<br>IEGPTLRQWLAARA-GGGCGGGG-IEGPTLRQWLAARA | (SEQ. ID NO: 1003) |
| IEGPTLRQWLAARA-GGGGGGGG-IEGPTLRQWLAARA | (SEQ. ID NO: 1004) |
| Fc-IEGPTLRQWLAARA-GPNG-IEGPTLRQWLAARA | (SEQ. ID NO: 1005) |
| Fc-IEGPTLRQWLAARA-GPNG-IEGPTLRQWLAARA-Fc | (SEQ. ID NO: 1006) |
| IEGPTLRQWLAARA-GGGGGGGG-IEGPTLRQWLAARA-Fc | (SEQ. ID NO: 1007) |
| Fc-GG-IEGPTLRQWLAARA-GPNG-IEGPTLRQWLAARA | (SEQ. ID NO: 1008) |
| Fc-IEGPTLRQWLAARA-GGGGGGGG-IEGPTLRQWLAARA | (SEQ. ID NO: 1009) |
| Fc-IEGPTLRQCLAARA-GGGGGGGG-IEGPTLRQCLAARA (cyclic) | (SEQ. IDNO: 1010) |
| Fc-IEGPTLRQCLAARA-GGGGGGGG-IEGPTLRQCLAARA (linear) | (SEQ. ID NO: 1011) |
| Fc-IEGPTLRQALAARA-GGGGGGGG-IEGPTLRQALAARA | (SEQ. ID NO: 1012) |
| Fc-IEGPTLRQWLAARA-GGGKGGGG-IEGPTLRQWLAARA | (SEQ. ID NO: 1013) |
| Fc-IEGPTLRQWLAARA-GGGCGGGG-IEGPTLRQWLAARA | (SEQ. ID NO: 1014) |
| Fc-IEGPTLRQWLAARA-GGGNGSGG-IEGPTLRQWLAARA | (SEQ. ID NO: 1015) |
| Fc-IEGPTLRQWLAARA-GGGCGGGG-IEGPTLRQWLAARA<br>                                                                                                        \|<br>Fc-IEGPTLRQWLAARA-GGGCGGGG-IEGPTLRQWLAARA | (SEQ. ID NO: 1016) |
| Fc-GGGGG-IEGPTLRQWLAARA-GGGGGGGG-IEGPTLRQWLAARA | (SEQ. ID NO: 1017) |

3. One or more peptidyl [—C(O)NR—] linkages (bonds) is replaced by a non-peptidyl linkage. Exemplary non-peptidyl linkages are —CH2-carbamate [—CH2-OC(O)NR—], phosphonate, —CH2-sulfonamide [—CH2-S(O)$_2$NR-], urea [—NHC(O)NH—], —CH2-secondary amine, and alkylated peptide [—C(O)NR6- wherein R6 is lower alkyl].

4. The N-terminus is derivatized. Typically, the N-terminus may be acylated or modified to a substituted amine. Exemplary N-terminal derivative groups include —NRR1 (other than —NH2), —NRC(O)R1, —NRC(O)OR1, —NRS(O)$_2$R1, —NHC(O)NHR1, succinimide, or benzyloxycarbonyl-NH— (CBZ-NH—), wherein R and R1 are each independently hydrogen or lower alkyl and wherein the phenyl ring may be substituted with 1 to 3 substituents selected from the group consisting of C1-C4 alkyl, C1-C4 alkoxy, chloro, and bromo.

5. The free C-terminus is derivatized. Typically, the C-terminus is esterified or amidated. For example, one may use methods described in the art to add (NH—CH2-CH2-NH2)$_2$ to compounds of this invention. Likewise, one may use methods described in the art to add —NH2 to compounds of this invention. Exemplary C-terminal derivative groups include, for example, —C(O)R2 wherein R2 is lower alkoxy or —NR3R4 wherein R3 and R4 are independently hydrogen or C1-C8 alkyl (preferably C1-C4 alkyl).

6. A disulfide bond is replaced with another, preferably more stable, cross-linking moiety (e.g., an alkylene). See, e.g., Bhatnagar et al. (1996), J. Med. Chem. 39: 3814-9; Alberts et al. (1993) Thirteenth Am. Pep. Symp., 357-9.

7. One or more individual amino acid residues is modified. Various derivatizing agents are known to react specifically with selected sidechains or terminal residues, as described in detail below.

8. Heterobifunctional polymers are typically used to link proteins. An example is SMCC, or Succinimidyl-4-(N-maleimidomethyl)cyclohexane-1-carboxylate. The NHS (N-Hydroxylsuccinimide) end reacts with primary amines, which upon conjugation at pH ~7 is optimal. Once the complex is formed, reaction of the maleimide portion of SMCC can proceed with another protein/peptide containing a free sulfhydryl group, which occurs at a much faster rate than the formation of the amide in the initial reaction. The result is a link between two proteins, for example, antibody-enzyme conjugates. An application is illustrated by the preparation of crosslinked Fab' fragments to horseradish peroxidase (Ishikwa, et. al., 1983a,b; Yoshitake et al., 1982a,b; Imagawa et al, 1982; Uto et al., 1991). The use of Sulfo SMCC (Sulfosuccinimidyl-4-(N-maleimidomethyl)cyclohexane-1-carboxylate) allows for water solubility so that an organic solubilization step is not needed, allowing for greater flexibility and less disruption of activity in reacting with proteins.

Lysinyl residues and amino terminal residues may be reacted with succinic or other carboxylic acid anhydrides, which reverse the charge of the lysinyl residues. Other suitable reagents for derivatizing alpha-amino-containing residues include imidoesters such as methyl picolinimidate; pyridoxal phosphate; pyridoxal; chloroborohydride; trinitrobenzenesulfonic acid; O-methylisourea; 2,4 pentanedione; and transaminase-catalyzed reaction with glyoxylate.

Arginyl residues may be modified by reaction with any one or combination of several conventional reagents, including phenylglyoxal, 2,3-butanedione, 1,2-cyclohexanedione, and ninhydrin. Derivatization of arginyl residues requires that the reaction be performed in alkaline conditions because of the high pKa of the guanidine functional group. Furthermore, these reagents may react with the groups of lysine as well as the arginine epsilon-amino group.

Specific modification of tyrosyl residues has been studied extensively, with particular interest in introducing spectral labels into tyrosyl residues by reaction with aromatic diazonium compounds or tetranitromethane. Most commonly, N-acetylimidizole and tetranitromethane are used to form O-acetyl tyrosyl species and 3-nitro derivatives, respectively.

Carboxyl sidechain groups (aspartyl or glutamyl) may be selectively modified by reaction with carbodiimides (R'—N=C=N—R') such as 1-cyclohexyl-3-(2-morpholinyl-(4-ethyl) carbodiimide or 1-ethyl-3-(4-azonia-4,4-dimethylpentyl) carbodiimide. Furthermore, aspartyl and glutamyl residues may be converted to asparaginyl and glutaminyl residues by reaction with ammonium ions.

Glutaminyl and asparaginyl residues may be deamidated to the corresponding glutamyl and aspartyl residues. Alternatively, these residues are deamidated under mildly acidic conditions. Either form of these residues falls within the scope of this invention.

Cysteinyl residues can be replaced by amino acid residues or other moieties either to eliminate disulfide bonding or, conversely, to stabilize cross-linking. See, e.g., Bhatnagar et al. (1996), J. Med. Chem. 39: 3814-9.

Derivatization with bifunctional agents is useful for cross-linking the peptides or their functional derivatives to a water-insoluble support matrix or to other macromolecular vehicles. Commonly used cross-linking agents include, e.g., 1,1-bis (diazoacetyl)-2-phenylethane, glutaraldehyde, N-hydroxysuccinimide esters, for example, esters with 4-azidosalicylic acid, homobifunctional imidoesters, including disuccinimidyl esters such as 3,3'-dithiobis(succinimidylpropionate), and bifunctional maleimides such as bis-N-maleimido-1,8-octane. Derivatizing agents such as methyl-3-[(p-azidophenyl)dithio]propioimidate yield photoactivatable intermediates that are capable of forming crosslinks in the presence of light. Alternatively, reactive water-insoluble matrices such as cyanogen bromide-activated carbohydrates and the reactive substrates described in U.S. Pat. Nos. 3,969,287; 3,691,016; 4,195,128; 4,247,642; 4,229,537; and 4,330,440 are employed for protein immobilization.

Carbohydrate (oligosaccharide) groups may conveniently be attached to sites that are known to be glycosylation sites in proteins. Generally, O-linked oligosaccharides are attached to serine (Ser) or threonine (Thr) residues while N-linked oligosaccharides are attached to asparagine (Asn) residues when they are part of the sequence Asn-X-Ser/Thr, where X can be any amino acid except proline. X is preferably one of the 19 naturally occurring amino acids other than proline. The structures of N-linked and O-linked oligosaccharides and the sugar residues found in each type are different. One type of sugar that is commonly found on both is N-acetylneuraminic acid (referred to as sialic acid). Sialic acid is usually the terminal residue of both N-linked and O-linked oligosaccharides and, by virtue of its negative charge, may confer acidic properties to the glycosylated compound. Such site(s) may be incorporated in the linker of the compounds of this invention and are preferably glycosylated by a cell during recombinant production of the polypeptide compounds (e.g., in mammalian cells such as CHO, BHK, COS). However, such sites may further be glycosylated by synthetic or semi-synthetic procedures known in the art.

Other possible modifications include hydroxylation of proline and lysine, phosphorylation of hydroxyl groups of seryl or threonyl residues, oxidation of the sulfur atom in Cys, methylation of the alpha-amino groups of lysine, arginine, and histidine side chains. Creighton, Proteins: Structure and Molecule Properties (W. H. Freeman & Co., San Francisco), pp. 79-86 (1983).

Compounds of the present invention may be changed at the DNA level, as well. The DNA sequence of any portion of the compound may be changed to codons more compatible with the chosen host cell. For E. coli, which is the preferred host cell, optimized codons are known in the art. Codons may be substituted to eliminate restriction sites or to include silent restriction sites, which may aid in processing of the DNA in the selected host cell. The vehicle, linker and peptide DNA sequences may be modified to include any of the foregoing sequence changes.

Isotope- and toxin-conjugated derivatives. Another set of useful derivatives are the above-described molecules conjugated to toxins, tracers, or radioisotopes. Such conjugation is especially useful for molecules comprising peptide sequences that bind to tumor cells or pathogens. Such molecules may be used as therapeutic agents or as an aid to surgery (e.g., radioimmunoguided surgery or RIGS) or as diagnostic agents (e.g., radioimmunodiagnostics or RID).

As therapeutic agents, these conjugated derivatives possess a number of advantages. They facilitate use of toxins and radioisotopes that would be toxic if administered without the specific binding provided by the peptide sequence. They also can reduce the side-effects that attend the use of radiation and chemotherapy by facilitating lower effective doses of the conjugation partner.

Useful conjugation partners include:
radioisotopes, such as 90Yttrium, 131Iodine, 225Actinium, and 213Bismuth;
ricin A toxin, microbially derived toxins such as Pseudomonas endotoxin (e.g., PE38, PE40), and the like;
partner molecules in capture systems (see below);
biotin, streptavidin (useful as either partner molecules in capture systems- or as tracers, especially for diagnostic use); and
cytotoxic agents (e.g., doxorubicin).

One useful adaptation of these conjugated derivatives is use in a capture system. In such a system, the molecule of the present invention would comprise a benign capture molecule. This capture molecule would be able to specifically bind to a separate effector molecule comprising, for example, a toxin or radioisotope. Both the vehicle-conjugated molecule and the effector molecule would be administered to the patient. In such a system, the effector molecule would have a short half-life except when bound to the vehicle-conjugated capture molecule, thus minimizing any toxic side-effects. The vehicle-conjugated molecule would have a relatively long half-life but would be benign and non-toxic. The specific binding portions of both molecules can be part of a known specific binding pair (e.g., biotin, streptavidin) or can result from peptide generation methods such as those described herein.

Such conjugated derivatives may be prepared by methods known in the art. In the case of protein effector molecules (e.g., Pseudomonas endotoxin), such molecules can be expressed as fusion proteins from correlative DNA constructs. Radioisotope conjugated derivatives may be prepared, for example, as described for the BEXA antibody (Coulter). Derivatives comprising cytotoxic agents or microbial toxins may be prepared, for example, as described for the BR96 antibody (Bristol-Myers Squibb). Molecules employed in capture systems may be prepared, for example, as described by the patents, patent applications, and publications from NeoRx. Molecules employed for RIGS and RID may be prepared, for example, by the patents, patent applications, and publications from NeoProbe.

Vehicles

The invention requires the presence of at least one vehicle attached to a peptide through the N-terminus, C-terminus or a sidechain of one of the amino acid residues. Multiple vehicles may also be used. In one aspect, an Fc domain is the vehicle. The Fc domain may be fused to the N or C termini of the peptides or at both the N and C termini.

In various embodiments of the invention, the Fc component is either a native Fc or an Fc variant. The immunoglobulin source of the native Fc is, in one aspect, of human origin and may, in alternative embodiments, be of any class of immunoglobulin. Native Fc domains are made up of monomeric polypeptides that may be linked into dimeric or multimeric forms by covalent (i.e., disulfide bonds) and/or non-covalent association. The number of intermolecular disulfide bonds between monomeric subunits of native Fc molecules ranges from one to four depending on class (e.g., IgG, IgA, IgE) or subclass (e.g., IgG1, IgG2, IgG3, IgA1, IgGA2). One example of a native Fc is a disulfide-bonded dimer resulting from papain digestion of an IgG (see Ellison et al. (1982), Nucleic Acids Res. 10: 4071-9).

It should be noted that Fc monomers will spontaneously dimerize when the appropriate cysteine residues are present, unless particular conditions are present that prevent dimerization through disulfide bond formation. Even if the cysteine residues that normally form disulfide bonds in the Fc dimer are removed or replaced by other residues, the monomeric chains will generally form a dimer through non-covalent interactions. The term "Fc" herein is used to mean any of these forms: the native monomer, the native dimer (disulfide bond linked), modified dimers (disulfide and/or non-covalently linked), and modified monomers (i.e., derivatives).

As noted, Fc variants are suitable vehicles within the scope of this invention. A native Fc may be extensively modified to form an Fc variant, provided binding to the salvage receptor is maintained; see, for example WO 97/34631 and WO 96/32478. In such Fc variants, one may remove one or more sites of a native Fc that provide structural features or functional activity not required by the fusion molecules of this invention. One may remove these sites by, for example, substituting or deleting residues, inserting residues into the site, or truncating portions containing the site. The inserted or substituted residues may also be altered amino acids, such as peptidomimetics or D-amino acids. Fc variants may be desirable for a number of reasons, several of which are described herein. Exemplary Fc variants include molecules and sequences in which:

1. Sites involved in disulfide bond formation are removed. Such removal may avoid reaction with other cysteine-containing proteins present in the host cell used to produce the molecules of the invention. For this purpose, the cysteine-containing segment at the N-terminus may be truncated or cysteine residues may be deleted or substituted with other amino acids (e.g., alanyl, seryl). Even when cysteine residues are removed, the single chain Fc domains can still form a dimeric Fc domain that is held together non-covalently.

2. A native Fc is modified to make it more compatible with a selected host cell. For example, one may remove the PA sequence near the N-terminus of a typical native Fc, which may be recognized by a digestive enzyme in E. coli such as proline iminopeptidase. One may also add an N-terminal methionine residue, especially when the molecule is expressed recombinantly in a bacterial cell such as E. coli.

3. A portion of the N-terminus of a native Fc is removed to prevent N-terminal heterogeneity when expressed in a selected host cell. For this purpose, one may delete any of the first 20 amino acid residues at the N-terminus, particularly those at positions 1, 2, 3, 4 and 5.

4. One or more glycosylation sites are removed. Residues that are typically glycosylated (e.g., asparagine) may confer cytolytic response. Such residues may be deleted or substituted with unglycosylated residues (e.g., alanine).

5. Sites involved in interaction with complement, such as the C1q binding site, are removed. For example, one may delete or substitute the EKK sequence of human IgG1. Complement recruitment may not be advantageous for the molecules of this invention and so may be avoided with such an Fc variant.

6. Sites are removed that affect binding to Fc receptors other than a salvage receptor. A native Fc may have sites for interaction with certain white blood cells that are not required for the fusion molecules of the present invention and so may be removed.

7. The ADCC site is removed. ADCC sites are known in the art; see, for example, Molec. Immunol. 29 (5): 633-9 (1992) with regard to ADCC sites in IgG1. These sites, as well, are not required for the fusion molecules of the present invention and so may be removed.

8. When the native Fc is derived from a non-human antibody, the native Fc may be humanized. Typically, to humanize a native Fc, one will substitute selected residues in the non-human native Fc with residues that are normally found in human native Fc. Techniques for antibody humanization are well known in the art.

An alternative vehicle would be a protein, polypeptide, peptide, antibody, antibody fragment, or small molecule (e.g., a peptidomimetic compound) capable of binding to a salvage receptor. For example, one could use as a vehicle a polypeptide as described in U.S. Pat. No. 5,739,277, issued Apr. 14, 1998 to Presta et al. Peptides could also be selected by phage display for binding to the FcRn salvage receptor. Such salvage receptor-binding compounds are also included within the meaning of "vehicle" and are within the scope of this invention. Such vehicles should be selected for increased half-life (e.g., by avoiding sequences recognized by proteases) and decreased immunogenicity (e.g., by favoring non-immunogenic sequences, as discovered in antibody humanization).

Variants, analogs or derivatives of the Fc portion may be constructed by, for example, making various substitutions of residues or sequences.

Variant (or analog) polypeptides include insertion variants, wherein one or more amino acid residues supplement an Fc amino acid sequence. Insertions may be located at either or both termini of the protein, or may be positioned within internal regions of the Fc amino acid sequence. Insertion variants, with additional residues at either or both termini, can include for example, fusion proteins and proteins including amino acid tags or labels. For example, the Fc molecule may optionally contain an N-terminal Met, especially when the molecule is expressed recombinantly in a bacterial cell such as E. coli.

In Fc deletion variants, one or more amino acid residues in an Fc polypeptide are removed. Deletions can be effected at one or both termini of the Fc polypeptide, or with removal of one or more residues within the Fc amino acid sequence. Deletion variants, therefore, include all fragments of an Fc polypeptide sequence.

In Fc substitution variants, one or more amino acid residues of an Fc polypeptide are removed and replaced with alternative residues. In one aspect, the substitutions are conservative in nature and conservative substitutions of this type are well known in the art. Alternatively, the invention embraces substitutions that are also non-conservative. Exemplary conservative substitutions are described in Lehninger, [Biochemistry, 2nd Edition; Worth Publishers, Inc. New York (1975), pp. 71-77] and set out immediately below.

| CONSERVATIVE SUBSTITUTIONS I | |
|---|---|
| SIDE CHAIN CHARACTERISTIC | AMINO ACID |
| Non-polar (hydrophobic): | |
| A. Aliphatic | A L I V P |
| B. Aromatic | F W |
| C. Sulfur-containing | M |
| D. Borderline | G |
| Uncharged-polar: | |
| A. Hydroxyl | S T Y |
| B. Amides | N Q |
| C. Sulfhydryl | C |
| D. Borderline | G |
| Positively charged (basic) | K R H |
| Negatively charged (acidic) | D E |

Alternative, exemplary conservative substitutions are set out immediately below.

| CONSERVATIVE SUBSTITUTIONS II | |
|---|---|
| ORIGINAL RESIDUE | EXEMPLARY SUBSTITUTION |
| Ala (A) | Val, Leu, Ile |
| Arg (R) | Lys, Gln, Asn |
| Asn (N) | Gln, His, Lys, Arg |
| Asp (D) | Glu |
| Cys (C) | Ser |
| Gln (Q) | Asn |
| Glu (E) | Asp |
| His (H) | Asn, Gln, Lys, Arg |
| Ile (I) | Leu, Val, Met, Ala, Phe, |
| Leu (L) | Ile, Val, Met, Ala, Phe |
| Lys (K) | Arg, Gln, Asn |
| Met (M) | Leu, Phe, Ile |
| Phe (F) | Leu, Val, Ile, Ala |
| Pro (P) | Gly |
| Ser (S) | Thr |
| Thr (T) | Ser |
| Trp (W) | Tyr |
| Tyr (Y) | Trp, Phe, Thr, Ser |
| Val (V) | Ile, Leu, Met, Phe, Ala |

For example, cysteine residues can be deleted or replaced with other amino acids to prevent formation of some or all disulfide crosslinks of the Fc sequences. Each cysteine residue can be removed and/or substituted with other amino acids, such as Ala or Ser. As another example, modifications may also be made to introduce amino acid substitutions to (1) ablate the Fc receptor binding site; (2) ablate the complement (C1q) binding site; and/or to (3) ablate the antibody dependent cell-mediated cytotoxicity (ADCC) site. Such sites are known in the art, and any known substitutions are within the scope of Fc as used herein. For example, see Molecular Immunology, Vol. 29, No. 5, 633-639 (1992) with regard to ADCC sites in IgG1.

Likewise, one or more tyrosine residues can be replaced by phenylalanine residues. In addition, other variant amino acid insertions, deletions and/or substitutions are also contemplated and are within the scope of the present invention. Conservative amino acid substitutions will generally be preferred. Furthermore, alterations may be in the form of altered amino acids, such as peptidomimetics or D-amino acids.

Fc sequences of the compound may also be derivatized as described herein for peptides, i.e., bearing modifications other than insertion, deletion, or substitution of amino acid residues. Preferably, the modifications are covalent in nature, and include for example, chemical bonding with polymers, lipids, other organic, and inorganic moieties. Derivatives of the invention may be prepared to increase circulating half-life, or may be designed to improve targeting capacity for the polypeptide to desired cells, tissues, or organs.

It is also possible to use the salvage receptor binding domain of the intact Fc molecule as the Fc part of a compound of the invention, such as described in WO 96/32478, entitled "Altered Polypeptides with Increased Half-Life." Additional members of the class of molecules designated as Fc herein are those that are described in WO 97/34631, entitled "Immunoglobulin-Like Domains with Increased Half-Lives." Both of the published PCT applications cited in this paragraph are hereby incorporated by reference.

WSP Components

Compounds of the invention may further include at least one WSP. The WPS moiety of the molecule may be branched or unbranched. For therapeutic use of the end-product preparation, the polymer is pharmaceutically acceptable. In general, a desired polymer is selected based on such considerations as whether the polymer conjugate will be used therapeutically, and if so, the desired dosage, circulation time, resistance to proteolysis, and other considerations. In various aspects, the average molecular weight of each water soluble polymer is between about 2 kDa and about 100 kDa, between about 5 kDa and about 50 kDa, between about 12 kDa and about 40 kDa and between about 20 kDa and about 35 kDa. In yet another aspect the molecular weight of each polymer is between about 6 kDa and about 25 kDa. The term "about" as used herein and throughout, indicates that in preparations of a water soluble polymer, some molecules will weigh more, some less, than the stated molecular weight. Generally, the higher the molecular weight or the more branches, the higher the polymer/protein ratio. Other sizes may be used, depending on the desired therapeutic profile including for example, the duration of sustained release; the effects, if any, on biological activity; the ease in handling; the degree or lack of antigenicity and other known effects of a water soluble polymer on a therapeutic protein.

The WSP should be attached to a polypeptide or peptide with consideration given to effects on functional or antigenic domains of the polypeptide or peptide. In general, chemical derivatization may be performed under any suitable condition used to react a protein with an activated polymer molecule. Activating groups which can be used to link the water soluble polymer to one or more proteins include without limitation sulfone, maleimide, sulfhydryl, thiol, triflate, tresylate, azidirine, oxirane and 5-pyridyl. If attached to the peptide by reductive alkylation, the polymer selected should have a single reactive aldehyde so that the degree of polymerization is controlled.

Suitable, clinically acceptable, water soluble polymers include without limitation, PEG, polyethylene glycol propionaldehyde, copolymers of ethylene glycol/propylene glycol, monomethoxy-polyethylene glycol, carboxymethylcellulose, polyacetals, polyvinyl alcohol (PVA), polyvinyl pyrrolidone, poly-1,3-dioxolane, poly-1,3,6-trioxane, ethylene/maleic anhydride copolymer, poly (.beta.-amino acids) (either homopolymers or random copolymers), poly(n-vinyl pyrrolidone)polyethylene glycol, propropylene glycol homopolymers (PPG) and other polyakylene oxides, polypropylene oxide/ethylene oxide copolymers, polyoxyethylated polyols (POG) (e.g., glycerol) and other polyoxyethylated polyols, polyoxyethylated sorbitol, or polyoxyethylated glucose, colonic acids or other carbohydrate polymers, Ficoll or dextran and mixtures thereof.

Water Soluble Polymers can also be made to be thermally sensitive, as in the formation of reverse thermal gels. Examples include Tetronics, with tetra armed backbones, and PEG-PLGA copolymers. The hydrophilicity of polymers can be varied by substituting hydrophobic portions into the polymer chain. An example of this is in the manufacture of PLGA, in which the ratio of lactic acid to glycolic acid can be increased to allow for lower water solubility. Lower water soluble polymers may be desired in certain applications, for example in increasing the potential to interact with cell membranes. Upon reconstitution, an appropriate ratio of phospholipids may be used to induce the formation of micelles or liposomes in solution. The advantage of such a system may be in the ability to incorporate some of the protein within the micelle, with the potential benefit of prolonging delivery. Phospholipids capable of forming liposomes or micelles include DMPG, DMPC, DOPC, DOPG and appropriate secondary liposome strengthening components such as cholesterol. Certain excipients, such as DEA oleth-10 phosphate and oleth 10-phosphate, are capable of forming micelles in solution.

Polysaccharide polymers are another type of water soluble polymer which may be used for protein or peptide modification. Modifying proteins or peptides by adding polysaccharide(s), e.g., glycosylation, may increase half-life, decrease antigenicity, increase stability and decrease proteolysis. Dextrans are polysaccharide polymers comprised of individual subunits of glucose predominantly linked by α1-6 linkages. The dextran itself is available in many molecular weight ranges, and is readily available in molecular weights from about 1 kD to about 70 kD. Dextran is a suitable water soluble polymer for use in the present invention as a vehicle by itself or in combination with another vehicle (e.g., Fc). See, for example, WO 96/11953 and WO 96/05309. The use of dextran conjugated to therapeutic or diagnostic immunoglobulins has been reported; see, for example, European Patent Publication No. 0 315 456, which is hereby incorporated by reference. Dextran of about 1 kD to about 20 kD is preferred when dextran is used as a vehicle in accordance with the present invention.

In one embodiment, the WSP is PEG and the invention contemplates preparations wherein a compound is modified to include any of the forms of PEG that have been used to derivatize other proteins, such as and without limitation mono-(C1-C10) alkoxy- or aryloxy-polyethylene glycol. Polyethylene glycol propionaldehyde may have advantages in manufacturing due to its stability in water. The PEG group may be of any convenient molecular weight and may be linear or branched. The average molecular weight of PEG contemplated for use in the invention ranges from about 2 kDa to about 100 kDa, from about 5 kDa to about 50 kDa, from about 5 kDa to about 10 kDa. In another aspect, the PEG moiety has a molecular weight from about 6 kDa to about 25 kDa. PEG groups generally are attached to peptides or proteins via acylation or reductive alkylation through a reactive group on the PEG moiety (e.g., an aldehyde, amino, thiol, or ester group) to a reactive group on the target peptide or protein (e.g., an aldehyde, amino, or ester group). Using methods described herein, a mixture of polymer/peptide conjugate molecules can be prepared, and the advantage provided herein is the ability to select the proportion of polymer/peptide conjugate to include in the mixture. Thus, if desired, a mixture of peptides with various numbers of polymer moieties attached (i.e., zero, one or two) can be prepared with a predetermined proportion of polymer/protein conjugate.

A useful strategy for the PEGylation (other methods are discussed in more detail herein) of synthetic peptides consists of combining, through forming a conjugate linkage in solution, a peptide and a PEG moiety, each bearing a special functionality that is mutually reactive toward the other. The peptides can be easily prepared with conventional solid phase synthesis. The peptides are "preactivated" with an appropriate functional group at a specific site. The precursors are purified and fully characterized prior to reacting with the PEG moiety. Ligation of the peptide with PEG usually takes place in aqueous phase and can be easily monitored by reverse phase analytical HPLC. The PEGylated peptides can be easily purified by preparative HPLC and characterized by analytical HPLC, amino acid analysis and laser desorption mass spectrometry.

Linkers

Any "linker" group is optional, whether positioned between peptides, peptide and vehicle or vehicle and WSP. When present, its chemical structure is not critical, since it serves primarily as a spacer. The linker is preferably made up of amino acids linked together by peptide bonds. Thus, in preferred embodiments, the linker is made up of from 1 to 20 amino acids linked by peptide bonds, wherein the amino acids are selected from the 20 naturally occurring amino acids. Some of these amino acids may be glycosylated, as is well understood by those in the art. In a more preferred embodiment, the 1 to 20 amino acids are selected from glycine, alanine, proline, asparagine, glutamine, and lysine. Even more preferably, a linker is made up of a majority of amino acids that are sterically unhindered, such as glycine and alanine Thus, preferred linkers are polyglycines (particularly (Gly)4 (SEQ ID NO:1702), (Gly)5 (SEQ ID NO:1703), (Gly)8 (SEQ ID NO:1704), poly(Gly-Ala), and polyalanines. Other specific examples of linkers are:

| | |
|---|---|
| (Gly)3Lys(Gly)4; | (SEQ ID NO: 1018) |
| (Gly)3AsnGlySer(Gly)2; | (SEQ ID NO: 1019) |
| (Gly)3Cys(Gly)4; and | (SEQ ID NO: 1020) |
| GlyProAsnGlyGly. | (SEQ ID NO: 1021) |

To explain the above nomenclature, for example, (Gly)3Lys(Gly)4 (SEQ ID NO:1018) means Gly-Gly-Gly-Lys-Gly-Gly-Gly-Gly (SEQ ID NO:1018). Combinations of Gly and Ala are also preferred. The linkers shown here are exemplary; linkers within the scope of this invention may be much longer and may include other residues.

Non-peptide linkers are also possible. For example, alkyl linkers such as —NH—(CH2)s—C(O)—, wherein s=2-20 could be used. These alkyl linkers may further be substituted by any non-sterically hindering group such as lower alkyl (e.g., C1-C6) lower acyl, halogen (e.g., Cl, Br), CN, NH2, phenyl, etc. An exemplary non-peptide linker is a PEG linker,

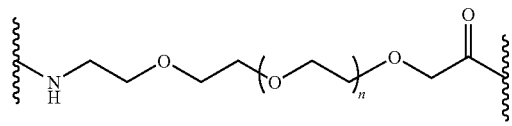

wherein n is such that the linker has a molecular weight of 100 to 5000 kD, preferably 100 to 500 kD. The peptide linkers may be altered to form derivatives in the same manner as described above.

Polypeptide and Peptide Production

A peptide having been identified may be made in transformed host cells using recombinant DNA techniques. If the vehicle component is a polypeptide, the polypeptide- or peptide-vehicle fusion product may be expressed as one. To do so, a recombinant DNA molecule encoding the peptide is first prepared using methods well known in the art. For instance, sequences coding for the peptides could be excised from DNA using suitable restriction enzymes. Alternatively, the DNA molecule could be synthesized using chemical synthesis techniques, such as the phosphoramidate method. Also, a combination of these techniques could be used. The invention therefore provides polynucleotides encoding a compound of the invention.

The invention also provides vectors encoding compounds of the invention in an appropriate host. The vector comprises the polynucleotide that encodes the compound operatively linked to appropriate expression control sequences. Methods of effecting this operative linking, either before or after the polynucleotide is inserted into the vector, are well known. Expression control sequences include promoters, activators, enhancers, operators, ribosomal binding sites, start signals, stop signals, cap signals, polyadenylation signals, and other signals involved with the control of transcription or translation.

The resulting vector having the polynucleotide therein is used to transform an appropriate host. This transformation may be performed using methods well known in the art.

Any of a large number of available and well-known host cells may be used in the practice of this invention. The selection of a particular host is dependent upon a number of factors recognized by the art. These include, for example, compatibility with the chosen expression vector, toxicity of the peptides encoded by the DNA molecule, rate of transformation, ease of recovery of the peptides, expression characteristics, bio-safety and costs. A balance of these factors must be struck with the understanding that not all hosts may be equally effective for the expression of a particular DNA sequence. Within these general guidelines, useful microbial hosts include bacteria (such as *E. coli*), yeast (such as *Saccharomyces*) and other fungi, insects, plants, mammalian (including human) cells in culture, or other hosts known in the art.

Next, the transformed host is cultured and purified. Host cells may be cultured under conventional fermentation conditions so that the desired compounds are expressed. Such fermentation conditions are well known in the art. Finally, the peptides are purified from culture by methods well known in the art.

Depending on the host cell utilized to express a compound of the invention, carbohydrate (oligosaccharide) groups may conveniently be attached to sites that are known to be glycosylation sites in proteins. Generally, O-linked oligosaccharides are attached to serine (Ser) or threonine (Thr) residues while N-linked oligosaccharides are attached to asparagine (Asn) residues when they are part of the sequence Asn-X-Ser/Thr, where X can be any amino acid except proline. X is preferably one of the 19 naturally occurring amino acids not counting proline. The structures of N-linked and O-linked oligosaccharides and the sugar residues found in each type are different. One type of sugar that is commonly found on both is N-acetylneuraminic acid (referred to as sialic acid). Sialic acid is usually the terminal residue of both N-linked and O-linked oligosaccharides and, by virtue of its negative charge, may confer acidic properties to the glycosylated compound. Such site(s) may be incorporated in the linker of the compounds of this invention and are preferably glycosylated by a cell during recombinant production of the polypeptide compounds (e.g., in mammalian cells such as CHO, BHK, COS). However, such sites may further be glycosylated by synthetic or semi-synthetic procedures known in the art.

Alternatively, the compounds may be made by synthetic methods. For example, solid phase synthesis techniques may be used. Suitable techniques are well known in the art, and include those described in Merrifield (1973), Chem. Polypeptides, pp. 335-61 (Katsoyannis and Panayotis eds.); Merrifield (1963), J. Am. Chem. Soc. 85: 2149; Davis et al. (1985), Biochem. Intl. 10: 394-414; Stewart and Young (1969), Solid Phase Peptide Synthesis; U.S. Pat. No. 3,941,763; Finn et al. (1976), The Proteins (3rd ed.) 2: 105-253; and Erickson et al. (1976), The Proteins (3rd ed.) 2: 257-527. Solid phase synthesis is the preferred technique of making individual peptides since it is the most cost-effective method of making small peptides.

Compounds that contain derivatized peptides or which contain non-peptide groups are particularly amendable to synthesis by well-known organic chemistry techniques.

WSP Modification

For obtaining a compound covalently attached to a WSP, any method described herein or otherwise known in the art is employed. Methods for preparing chemical derivatives of polypeptides or peptides will generally comprise the steps of (a) reacting the peptide with the activated polymer molecule (such as a reactive ester or aldehyde derivative of the polymer molecule) under conditions whereby the polypeptide becomes attached to one or more polymer molecules, and (b) obtaining the reaction product(s). The optimal reaction conditions will be determined based on known parameters and the desired result. For example, the larger the ratio of polymer molecules:protein, the greater the percentage of attached polymer molecule.

A biologically active molecule can be linked to a polymer through any available functional group using standard methods well known in the art. Examples of functional groups on either the polymer or biologically active molecule which can be used to form such linkages include amine and carboxy groups, thiol groups such as in cysteine resides, aldehydes and ketones, and hydroxy groups as can be found in serine, threonine, tyrosine, hydroxyproline and hydroxylysine residues.

The polymer can be activated by coupling a reactive group such as trichloro-s-triazine [Abuchowski, et al., (1977), J. Biol. Chem. 252:3582-3586, incorporated herein by reference in its entirety], carbonylimidazole [Beauchamp, et al., (1983), Anal. Biochem. 131:25-33, incorporated herein by reference in its entirety], or succinimidyl succinate [Abuchowski, et al., (1984), Cancer Biochem. Biophys. 7:175-186, incorporated herein by reference in its entirety] in order to react with an amine functionality on the biologically active molecule. Another coupling method involves formation of a glyoxylyl group on one molecule and an aminooxy, hydrazide or semicarbazide group on the other molecule to be conjugated [Fields and Dixon, (1968), Biochem. J. 108:883-887; Gaertner, et al., (1992), Bioconjugate Chem. 3:262-268; Geoghegan and Stroh, (1992), Bioconjugate Chem. 3:138-146; Gaertner, et al., (1994), J. Biol. Chem. 269:7224-7230, each of which is incorporated herein by reference in its entirety]. Other methods involve formation of an active ester at a free alcohol group of the first molecule to be conjugated using chloroformate or disuccinimidylcarbonate, which can then be conjugated to an amine group on the other molecule to be coupled [Veronese, et al., (1985), Biochem. and Biotech. 11:141-152; Nitecki, et al., U.S. Pat. No. 5,089,261; Nitecki, U.S. Pat. No. 5,281,698, each of which is incorporated herein by reference in its entirety]. Other reactive groups which may be attached via free alcohol groups are set forth in Wright, EP 0539167A2 (incorporated herein by reference in its entirety), which also describes the use of imidates for coupling via free amine groups.

Another chemistry involves acylation of the primary amines of a target using the NHS-ester of methoxy-PEG (O—[(N-succinimidyloxycarbonyl)-methyl]-O'-methylpolyethylene glycol). Acylation with methoxy-PEG-NHS results in an amide linkage which will eliminate the charge from the original primary amine. Other methods utilize mild oxidation of a target under conditions selected to target the pendant diol of the penultimate glycosyl unit sialic acid for oxidation to an aldehyde. The resultant glycoaldehyde was then reacted with a methoxy-PEG-hydrazide (O-(Hydrazinocarbonylmethyl)-O'-methylpolyethylene glycol) to form a semi-stable hydrazone between PEG and target. The hydrazone is subsequently reduced by sodium cyanoborohydride to produce a stable PEG conjugate. See for example, U.S. Pat. No. 6,586,398 (Kinstler, et al., Jul. 1, 2003), incorporated herein by reference in its entirety.

In specific applications of techniques for chemical modification, for example, U.S. Pat. No. 4,002,531 (incorporated herein by reference in its entirety) states that reductive alkylation was used for attachment of polyethylene glycol molecules to an enzyme. U.S. Pat. No. 4,179,337 (incorporated herein by reference in its entirety) discloses PEG:protein conjugates involving, for example, enzymes and insulin. U.S. Pat. No. 4,904,584 (incorporated herein by reference in its entirety) discloses the modification of the number of lysine residues in proteins for the attachment of polyethylene glycol molecules via reactive amine groups. U.S. Pat. No. 5,834,594 (incorporated herein by reference in its entirety) discloses substantially non-immunogenic water soluble PEG:protein conjugates, involving for example, the proteins IL-2, interferon alpha, and IL-1ra. The methods of Hakimi et al. involve the utilization of unique linkers to connect the various free amino groups in the protein to PEG. U.S. Pat. Nos. 5,824,784 and 5,985,265 (each of which is incorporated herein by reference in its entirety) teach methods allowing for selectively N-terminally chemically modified proteins and analogs thereof, including G-CSF and consensus interferon. Importantly, these modified proteins have advantages as relates to protein stability, as well as providing for processing advantages.

WSP modification is also described in Francis et al., In: Stability of protein pharmaceuticals: in vivo pathways of degradation and strategies for protein stabilization (Eds. Ahem., T. and Manning, M. C.) Plenum, N.Y., 1991 (incorporated herein by reference in its entirety), is used. In still another aspect, the method described in Delgado et al., "Coupling of PEG to Protein By Activation With Tresyl Chloride, Applications In Immunoaffinity Cell Preparation", In: Fisher et al., eds., Separations Using Aqueous Phase Systems, Applications In Cell Biology and Biotechnology, Plenum Press, N.Y., N.Y., 1989 pp. 211-213 (incorporated herein by reference in its entirety), which involves the use of tresyl chloride, which results in no linkage group between the WSP moiety and the polypeptide moiety. In other aspects, attachment of a WSP is effected through use of N-hydroxy succinimidyl esters of carboxymethyl methoxy polyethylene glycol, as well known in the art.

For other descriptions of modification of a target with a WSP, see, for example, U.S. patent application No.

20030096400; EP 0 442724A2; EP 0154316; EP 0401384; WO 94/13322; U.S. Pat. Nos. 5,362,852; 5,089,261; 5,281, 698; 6,423,685; 6,635,646; 6,433,135; International application WO 90/07938; Gaertner and Offord, (1996), Bioconjugate Chem. 7:38-44; Greenwald et al., Crit. Rev Therap Drug Carrier Syst. 2000; 17:101-161; Kopecek et al., J Controlled Release., 74:147-158, 2001; Harris et al., Clin Pharmacokinet. 2001; 40(7):539-51; Zalipsky et al., Bioconjug Chem. 1997; 8:111-118; Nathan et al., Macromolecules. 1992; 25:4476-4484; Nathan et al., Bioconj Chem. 1993; 4:54-62; and Francis et al., *Focus on Growth Factors,* 3:4-10 (1992), the disclosures of which are incorporated herein by reference in their entirety.

Reductive Alkylation

In one aspect, covalent attachment of a WSP is carried out by reductive alkylation chemical modification procedures as provided herein to selectively modify the N-terminal α-amino group, and testing the resultant product for the desired biological characteristic, such as the biological activity assays provided herein.

Reductive alkylation for attachment of a WSP to a protein or peptide exploits differential reactivity of different types of primary amino groups (e.g., lysine versus the N-terminal) available for derivatization in a particular protein. Under the appropriate reaction conditions, substantially selective derivatization of the protein at the N-terminus with a carbonyl group containing polymer is achieved.

For reductive alkylation, the polymer(s) selected could have a single reactive aldehyde group. A reactive aldehyde is, for example, polyethylene glycol propionaldehyde, which is water stable, or mono $C_1$-$C_{10}$ alkoxy or aryloxy derivatives thereof (see U.S. Pat. No. 5,252,714, incorporated herein by reference in its entirety). In one approach, reductive alkylation is employed to conjugate a PEG-aldehyde (O-(3-Oxopropyl)-O'-methylpolyethylene glycol) to a primary amine. Under appropriate conditions, this approach has been demonstrated to yield PEG conjugates predominately modified through the α-amine at the protein N-terminus.

An aldehyde functionality useful for conjugating the biologically active molecule can be generated from a functionality having adjacent amino and alcohol groups. In a polypeptide, for example, an N-terminal serine, threonine or hydroxylysine can be used to generate an aldehyde functionality via oxidative cleavage under mild conditions using periodate. These residues, or their equivalents, can be normally present, for example at the N-terminus of a polypeptide, may be exposed via chemical or enzymatic digestion, or may be introduced via recombinant or chemical methods. The reaction conditions for generating the aldehyde typically involve addition of a molar excess of sodium meta periodate and under mild conditions to avoid oxidation at other positions in the protein. The pH is preferably about 7.0. A typical reaction involves the addition of a 1.5 fold molar excess of sodium meta periodate, followed by incubation for 10 minutes at room temperature in the dark.

The aldehyde functional group can be coupled to an activated polymer containing a hydrazide or semicarbazide functionality to form a hydrazone or semicarbazone linkage. Hydrazide-containing polymers are commercially available, and can be synthesized, if necessary, using standard techniques. PEG hydrazides for use in the invention can be obtained from Shearwater Polymers, Inc., 2307 Spring Branch Road, Huntsville, Ala. 35801 (now part of Nektar Therapeutics, 150 Industrial Road, San Carlos, Calif. 94070-6256). The aldehyde is coupled to the polymer by mixing the solution of the two components together and heating to about 37° C. until the reaction is substantially complete. An excess of the polymer hydrazide is typically used to increase the amount of conjugate obtained. A typical reaction time is 26 hours. Depending on the thermal stability of the reactants, the reaction temperature and time can be altered to provide suitable results. Detailed determination of reaction conditions for both oxidation and coupling is set forth in Geoghegan and Stroh, (1992), Bioconjugate Chem. 3:138-146, and in Geoghegan, U.S. Pat. No. 5,362,852, each of which is incorporated herein by reference in its entirety.

Using reductive alkylation, the reducing agent should be stable in aqueous solution and preferably be able to reduce only the Schiff base formed in the initial process of reductive alkylation. Reducing agents are selected from, and without limitation, sodium borohydride, sodium cyanoborohydride, dimethylamine borate, trimethylamine borate and pyridine borate.

The reaction pH affects the ratio of polymer to protein to be used. In general, if the reaction pH is lower than the $pK_a$ of a target reactive group, a larger excess of polymer to protein will be desired. If the pH is higher than the target $pK_a$, the polymer:protein ratio need not be as large (i.e., more reactive groups are available, so fewer polymer molecules are needed).

Accordingly, the reaction is performed in one aspect at a pH which allows one to take advantage of the $pK_a$ differences between the ε-amino groups of the lysine residues and that of the α-amino group of the N-terminal residue of the protein. By such selective derivatization, attachment of a water soluble polymer to a protein is controlled; the conjugation with the polymer takes place predominantly at the N-terminus of the protein and no significant modification of other reactive groups, such as the lysine side chain amino groups, occurs.

In one aspect, therefore, methods are provided for covalent attachment of a WSP to a target compound and which provide a substantially homogenous preparation of WSP/protein conjugate molecules, in the absence of further extensive purification as is required using other chemical modification chemistries. More specifically, if polyethylene glycol is used, methods described allow for production of an N-terminally PEGylated protein lacking possibly antigenic linkage groups, i.e., the polyethylene glycol moiety is directly coupled to the protein moiety without potentially toxic by-products.

Depending on the method of WSP attachment chosen, the proportion of WSP molecules attached to the target peptide or protein molecule will vary, as will their concentrations in the reaction mixture. In general, the optimum ratio (in terms of efficiency of reaction in that there is no excess unreacted protein or polymer) is determined by the molecular weight of the WSP selected. In addition, when using methods that involve non-specific attachment and later purification of a desired species, the ratio may depend on the number of reactive groups (typically amino groups) available.

Purification

The method of obtaining a substantially homogeneous WSP-modified preparation is, in one aspect, by purification of a predominantly single species of modified compound from a mixture of species. By way of example, a substantially homogeneous species is first separated by ion exchange chromatography to obtain material having a charge characteristic of a single species (even though other species having the same apparent charge may be present), and then the desired species is separated using size exclusion chromatography. Other methods are reported and contemplated by the invention, includes for example, PCT WO 90/04606, published May 3, 1990, which describes a process for fractionating a mixture of PEG-protein adducts comprising partitioning the PEG/protein adducts in a PEG-containing aqueous biphasic system.

Thus, one aspect of the present invention is a method for preparing a WSP-modified compound conjugate comprised of (a) reacting a compound having more than one amino group with a water soluble polymer moiety under reducing alkylation conditions, at a pH suitable to selectively activate the α-amino group at the amino terminus of the protein moiety so that said water soluble polymer selectively attaches to said α-amino group; and (b) obtaining the reaction product. Optionally, and particularly for a therapeutic product, the reaction products are separated from unreacted moieties.

As ascertained by peptide mapping and N-terminal sequencing, a preparation is provided which comprises at least 50% PEGylated peptide in a mixture of PEGylated peptide and unreacted peptide. In other embodiments, preparations are provided which comprises at least 75% PEGylated peptide in a mixture of PEGylated peptide and unreacted peptide; at least 85% PEGylated peptide in a mixture of PEGylated peptide and unreacted peptide; at least 90% PEGylated peptide in a mixture of PEGylated peptide and unreacted peptide; at least 95% PEGylated peptide in a mixture of PEGylated peptide and unreacted peptide; and at least 99% PEGylated peptide in a mixture of PEGylated peptide and unreacted peptide.

The following examples are not intended to be limiting but only exemplary of specific embodiments of the invention.

Example 1 mFc-TMP Expression Construct Assembly

A polynucleotide encoding a TMP fusion protein comprising a murine Fc region (mFc-TMP) was constructed by combining nucleotide sequences individually encoding murine Fc and a TMP (described in EP01124961A2). In the first round of PCR, the murine Fc-encoding component was amplified with PCR primers 3155-58 (SEQ ID NO: 1022) and 1388-00 (SEQ ID NO: 1023).

```
3155-58:
CCGGGTAAAGGTGGAGGTGGTGGTATCGA    (SEQ ID NO: 1024)

3155-59:
CCACCTCCACCTTTACCCGGAGAGTGGGAG   (SEQ ID NO: 1025)
```

In a separate reaction, a TMP-encoding polynucleotide was amplified with primers 1209-85 (SEQ ID NO: 1026) and 3155-59 (SEQ ID NO: 1027).

```
1209-85:
CGTACAGGTTTACGCAAGAAAATGG        (SEQ ID NO: 1028)

1388-00:
CTAGTTATTGCTCAGCGG               (SEQ ID NO: 1029)
```

The resulting PCR fragments were gel purified and combined in a single tube for a second round of PCR with primers 1209-85 (SEQ ID NO: 1030) and 1388-00 (SEQ ID NO: 1031). The PCR product from this second round of amplification was gel purified and digested with restriction enzymes NdeI and XhoI. The digestion fragment was purified and ligated into the vector pAMG21, previously digested with the same enzymes. This ligation mix was transformed via electroporation into *E. coli* and plated onto LB+Kanamycin media. Colonies were screened via PCR and DNA sequencing. A positive clone with a nucleotide sequence (SEQ ID NO: 1032) encoding the mFc-TMP fusion protein (SEQ ID NO: 1033) was identified and designated 6397.

Murine Fc-TMP fusion protein-encoding polynucleotide (SEQ ID NO: 1034)

```
  1  GATTTGATTC TAGATTTGTT TTAACTAATT AAAGGAGGAA TAACAT

Open RF:
ATGGTCGACGGTTG TAAGCCATGC ATTTGTACAG TCCCAGAAGT ATCATCTGTC

101  TTCATCTTCC CCCCAAAGCC CAAGGATGTG CTCACCATTA CTCTGACTCC

151  TAAGGTCACG TGTGTTGTGG TAGACATCAG CAAGGATGAT CCCGAGGTCC

201  AGTTCAGCTG GTTTGTAGAT GATGTGGAGG TGCACACAGC TCAGACGCAA

251  CCCCGGGAGG AGCAGTTCAA CAGCACTTTC CGCTCAGTCA GTGAACTTCC

301  CATCATGCAC CAGGACTGGC TCAATGGCAA GGAGTTCAAA TGCAGGGTCA

351  ACAGTGCAGC TTTCCCTGCC CCATCGAGA AAACCATCTC CAAAACCAAA

401  GGCAGACCGA AGGCTCCACA GGTGTACACC ATTCCACCTC CCAAGGAGCA

451  GATGGCCAAG GATAAAGTCA GTCTGACCTG CATGATAACA GACTTCTTCC

501  CTGAAGACAT TACTGTGGAG TGGCAGTGGA ATGGGCAGCC AGCGGAGAAC

551  TACAAGAACA CTCAGCCCAT CATGGACACA GATGGCTCTT ACTTCGTCTA

601  CAGCAAGCTC AATGTGCAGA AGAGCAACTG GGAGGCAGGA AATACTTTCA

651  CCTGCTCTGT GTTACATGAG GGCCTGCACA ACCACCATAC TGAGAAGAGC

701  CTCTCCCACT CTCCGGGTAA AGGTGGAGGT GGTGGTATCG AAGGTCCGAC
```

```
                                          -continued
751   TCTGCGTCAG TGGCTGGCTG CTCGTGCTGG TGGTGGAGGT GGCGGCGGAG

801   GTATTGAGGG CCCAACCCTT CGCCAATGGC TTGCAGCACG CGCATAA

3' Sequence:
TCTCGAGGATCCG CGGAAAGAAG AAGAAGAAGA AGAAAGCCCG AAAGG
```

Murine Fc-TMP protein sequence (SEQ ID NO: 1035)

```
  1   MVDGCKPCIC TVPEVSSVFI FPPKPKDVLT ITLTPKVTCV VVDISKDDPE

51   VQFSWFVDDV EVHTAQTQPR EEQFNSTFRS VSELPIMHQD WLNGKEFKCR

101   VNSAAFPAPI EKTISKTKGR PKAPQVYTIP PPKEQMAKDK VSLTCMITDF

151   FPEDITVEWQ WNGQPAENYK NTQPIMDTDG SYFVYSKLNV QKSNWEAGNT

201   FTCSVLHEGL HNHHTEKSLS HSPGKGGGGG IEGPTLRQWL AARAGGGGGG

251   GGIEGPTLRQ WLAARA*
```

Example 2

Fermentation of Strain 6397

Fermentation of strain 6397 was initiated by inoculation of 500 mL of sterilized Luria broth with a seed culture of the strain in a shake flask. When cell density reached 0.9 at 600 nm, the contents were used to inoculate a 15 L fermentor containing 10 L of complex based growth medium (800 g glycerol, 500 g trypticase, 3 g sodium citrate, 40 g $KH_2PO_4$, 20 g $(NH_4)_2SO_4$, 5 ml Fluka P-2000 antifoam, 10 ml trace metals (ferric chloride 27.0 g/L, zinc chloride 2.00 g/L, cobalt chloride 2.00 g/L, sodium molybdate 2.00 g/L, calcium chloride 1.00 g/L, cupric sulfate 1.90 g/L, boric acid 0.50 g/L, manganese chloride 1.60 g/L, sodium citrate dihydrate 73.5 g/L), 10 ml vitamins (biotin 0.060 g/L, folic acid 0.040 g/L, riboflavin 0.42 g/L, pyridoxine HCl 1.40 g/L, niacin 6.10 g/L, pantothenic acid 5.40 g/L, sodium hydroxide 5.30 ml/L), add water to bring to 10 L). The fermenter was maintained at 37° C. and pH 7 with dissolved oxygen levels kept at a minimum of 30% saturation. When the cell density reached 13.1 OD units at 600 nm, the culture was induced by the addition 10 ml of 0.5 mg/ml N-(3-oxo-hexanoyl) homoserine lactone. At 6 hours post induction, the broth was chilled to 10° C., and the cells were harvested by centrifugation at 4550 g for 60 min at 5° C. The cell paste was then stored at −80° C.

Example 3

Protein Refolding

E. coli paste (300 g) from strain 6397 expressing mFc-TMP was dissolved in 2250 ml lysis buffer (50 mM Tris HCl, 5 mM EDTA, pH 8.0) and passed through a chilled microfluidizer two times at 13,000 PSI. The homogenate was then centrifuged at 11,300 g for 60 minutes at 4° C. The supernatant was discarded, and the pellet was resuspended in 2400 ml of water using a tissue grinder. The homogenate was then centrifuged at 11,300 g for 60 minutes at 4° C. The supernatant was discarded, and the pellet was resuspended in 200 ml volumes of water using a tissue grinder. The homogenate was centrifuged at 27,200 g for 30 minutes at 4° C., and the supernatant was discarded. About 12.5% of the pellet was resuspended in 28 ml 20 mM Tris HCl, pH 8.0, with 35 mg hen egg white lysozyme (Sigma, St Louis, Mo.) using a tissue grinder and incubated at 37° C. for 20 min. Following incubation, the suspension was centrifuged at 27,200 g for 30 minutes at 22° C., and the supernatant was discarded. The pellet was resuspended in 35 ml 8 M guanidine HCl, 50 mM Tris HCl, pH 8.0, after which 350 µl 1 M DTT (Sigma, St Louis, Mo.) was added and material was incubated at 37° C. for 30 minutes. The solution was then centrifuged at 27,200 g for 30 minutes at 22° C. The supernatant was then transferred to 3.5 L of refolding buffer (50 mM Tris base, 160 mM arginine HCl, 3 M urea, 20% glycerol, pH 9.5, 1 mM cysteine, 1 mM cystamine HCl) at 1 ml/min with gentle stirring at 4° C.

Example 4

Construct Purification

After about 40 hours incubation at 4° C. with gentle agitation, the refold solution described in Example 3 was concentrated to 500 µl using a tangential flow ultrafiltration apparatus with a 30 kDa cartridge (Satorius, Goettingen, Germany) followed by diafiltration against 3 L of Q-Buffer A (20 mM Tris HCl, pH 8.0). The concentrated material was filtered through a Whatman GF/A filter and loaded on to an 86 ml Q-Sepharose fast flow column (2.6 cm ID) (Amersham Biosciences, Piscataway, N.J.) at 15 ml/min. After washing the resin with several column volumes of Q-Buffer A, the protein was eluted using a 20 column volume linear gradient to 60% Q-Buffer B (20 mM Tris HCl, 1 M NaCl, pH 8.0) at 10 ml/min. The peak fractions were pooled, and the pool was passed through a Mustang E syringe filter (Pall Corporation, East Hills, N.Y.) at 1 ml/min. The filtered material was filtered a second time through a 0.22 µm cellulose acetate filter and stored at −80° C.

Example 5

Protein PEGylation

To a cooled (4° C.), stirred solution of mFc-TMP (3.5 ml, 0.8 mg/ml) in a 100 mM sodium acetate buffer, pH 5, containing 20 mM $NaCNBH_3$, was added a 3.8-fold molar excess of methoxypolyethylene glycol aldehyde (MPEG) (average molecular weight, 20 kDa) (Nektar). The stirring of the reaction mixture was continued at the same temperature. The extent of the protein modification during the course of the reaction was monitored by SEC HPLC using a Superose 6 HR 10/30 column (Amersham Biosciences) eluted with a 0.05 M phosphate buffer with 0.15 M NaCl, pH 7.0 at 0.4 ml/min. After 16 hours the SEC HPLC analysis indicated that the majority of the protein has been conjugated to MPEG. At this time the reaction mixture was buffer-exchanged into a 20 mM Tris/HCl buffer, pH 8.12. The MPEG-mFc-AMP2 conjugates were isolated by ion exchange chromatography using a 1 ml Hi Trap HP Q column (Amersham Biosciences) equilibrated with a 20 mM Tris/HCl buffer, pH 8.12. The reaction mixture was loaded on the column at a flow rate of 0.5 ml/min and the unreacted MPEG aldehyde was eluted with three column volumes of the starting buffer. A linear 20-column-volume gradient from 0% to 100% 20 mM Tris/HCl buffer, pH 8.12, containing 0.5 M NaCl was used to the elute the protein-polymer conjugates. Fractions (2 ml) collected during ion exchange chromatography separation were analyzed by HPLC SEC as described above. A fraction containing the mono- and di-MPEG-mFc-TMP conjugates in an approximate ratio of 2.3 to 1 (as determined by SEC HPLC) was concentrated, and sterile filtered.

Example 6

In Vivo Testing

BDF1 mice (Charles River Laboratories, Wilmington, Mass.) were divided into groups of 10 and injected on days 0, 21, and 42 subcutaneously with either diluting agent (Dulbecco's PBS with 0.1% bovine serum albumin) or diluting agent with 50 µg test mono- and di-MPEG-mFc-TMP conjugate protein (as described above) per kg animal. Each group was divided in half and bled (140 µl) from the retro-orbital sinus on alternate time points (days 0, 3, 5, 7, 10, 12, 14, 19, 24, 26, 28, 31, 33, 40, 45, 47, 49, 52 and 59). On day 59, mice were anesthetized with isoflurane prior to bleeding. The collected blood was analyzed for a complete and differential count using an ADVIA 120 automated blood analyzer with murine software (Bayer Diagnostics, New York, N.Y.).

Example 7

Lyophilized Human Fc-TMP

Initial Lyophilized Formulation Screening Studies

The human Fc-TMP peptibody described herein in Example 7 corresponds to a dimeric form of SEQ ID NO:1017, wherein the human Fc is SEQ ID NO:1, having an initiator methionine at the N-terminus.

The stability of Fc-TMP was assessed by several chromatographic techniques: Reversed-Phase HPLC, Cation-Exchange HPLC, Size-Exclusion HPLC and SDS-PAGE, all of which were stability-indicating at elevated temperature. Formulations ranging in concentration from 0.1 to 40 mg/ml were examined for both chemical and physical degradation at accelerated, refrigerated and frozen temperature. Fc-TMP stability was evaluated with respect to varying pH and the inclusion of mannitol or glycine as cake-forming agents and sucrose as a lyoprotectant. Mannitol and sucrose were eventually chosen for further optimization after the other candidate (glycine) showed no improvement in protein stability. Tween-20 (polysorbate-20) was also shown to inhibit aggregation upon lyophilization over a concentration range of 0.002 to 0.1%. The following buffers were examined in screening studies over a pH range of 4-8: glycine, succinate, histidine, phosphate, and Tris. From these screening studies, Fc-TMP formulated in histidine buffer at pH 5 with a small amount of Tween-20 (0.004%) added was shown to be more optimal for stability.

Validation of Sucrose and Tween-20 in the Fc-TMP Formulation

Subsequent development efforts were focused on validating the level of sucrose, mannitol and Tween-20 in the formulation at a protein concentration of approximately 0.5 mg/ml (to accommodate the anticipated dosing requirements in the clinic). The effect of sucrose, mannitol and Tween-20 in optimizing stability was demonstrated in these studies. Follow-up studies were also initiated for the purpose of anticipating manufacturing issues and concerns.

Sucrose is Beneficial in Minimizing Chemical Degradation at Elevated Temperature The effect of varying sucrose and mannitol concentrations on the stability of Fc-TMP was tested. The protein was formulated at 0.3 and 2 mg/ml in order to bracket the anticipated concentration range in the clinic. In addition, samples were prepared with and without 0.004% Tween-20. The ratio of sucrose:mannitol was changed by varying the amount of sucrose and adjusting the mannitol level at each sucrose concentration to maintain isotonicity. The following ratios of sucrose:mannitol were examined (expressed as percent weight per volume): 0.2:5.1; 0.5:4.8; 1:4.5; 1.5:4.3 and 2:4.

Higher ratios of sucrose:mannitol are shown to minimize chemical degradation as monitored by Cation-Exchange and Reversed-Phase HPLC. As is shown in Table 39, the percent main peak is compared initially and after elevated temperature storage of Fc-TMP for 18 weeks at 37° C. The greatest loss of cation-exchange main peak occurs in the liquid formulation (Fc-TMP formulated in 10 mM acetate, 5% sorbitol at pH 5), followed by the lyophilized formulations with 0.2, 0.5 and 1.0% sucrose, respectively. The protective effect of sucrose in minimizing chemical degradation was also observed by Reversed-Phase HPLC analysis of samples after elevated temperature storage (Table 39). The percent main peak (determined from reversed-phase HPLC analysis of Fc-TMP) drops significantly at the low sucrose levels, but does not appear to change meaningfully in formulations with sucrose concentrations of greater than 1%. Interpreted together, these results indicate that maintaining sucrose levels at 1.5% or higher is critical for the stability of Fc-TMP upon lyophilization.

TABLE 39

Fc-TMP in 10 mM Histidine, buffered at pH 5 with Tween-20
Loss of RP and CEX-HPLC Main Peak After 18 Weeks at 37° C.

| Formulation | RP-HPLC | | CEX-HPLC | |
|---|---|---|---|---|
| | Time Zero | 18 Weeks | Time Zero | 18 Weeks |
| 0.2% Sucrose, 5.1% Mannitol | 78.6 | 72.2 | 79.8 | 62.6 |
| 0.5% Sucrose, 4.8% Mannitol | 77.3 | 73.1 | 78.9 | 71.6 |
| 1% Sucrose, 4.5% Mannitol | 78.4 | 78.0 | 80.5 | 73.9 |
| 1.5% Sucrose, 4.3% Mannitol | 73.2 | 79.8 | 80.5 | 78.7 |
| 2% Sucrose, 4% Mannitol | 79.2 | 81.3 | 78.6 | 78.9 |
| 10 mM Acetate, 5% Sorbitol, pH 5 (liquid control) | 74.7 | 42.8 | 75.5 | 34.1 |

Whereas Fc-TMP in the liquid control (the 10 mM acetate, 5% sorbitol, pH 5 formulation) has significant growth in the pre- and post-main peak area, the protein shows more degradation in the post-main peak region upon analysis of lyophilized samples with lower amounts of sucrose. Previous work with liquid stability samples (after elevated temperature storage) has shown that deamidation arises from glutamine and arginine in the protein, which contributes to the growth in the pre-peak region in liquid samples.

At refrigerated temperature, chemical degradation is not observed by cation-exchange and reversed-phase HPLC in the lyophilized formulation after long term storage. For example, cation-exchange chromatograms did not show apparent changes under varied temperatures (−80° C., 4° C. and controlled room temperature for 6 months). Due to the lack of chemical degradation in the lyophilized formulation over time at controlled room temperature and lower, much of the formulation development work centered on minimizing the physical aggregation associated with freeze-drying.

Tween-20 Minimizes Aggregation Induced by Lyophilization

The inclusion of Tween-20 at a low concentration (0.004%) is needed to minimize a small amount of aggregation which is apparent following lyophilization. This can be demonstrated by examining the relevant results from several stability studies in which samples are evaluated for stability with and without the addition of Tween-20.

A higher protein concentration of Fc-TMP was first used to explore a wide range of Tween-20 in order to investigate the amount needed to minimize aggregation. The Fc-TMP concentration in this study was 20 mg/ml, with the Tween-20 levels set at 0.002, 0.004, 0.006 and 0.01%. After storage for one year at 4° C., aggregation is limited to <0.1% in all formulations with Tween-20. Six month results also showed no meaningful aggregation. Tween-20 at 0.004% was chosen for further consideration in the formulation studies, as discussed herein, designed for Fc-TMP at 0.5 mg/ml.

Table 40 shows the amount of aggregation in Fc-TMP monitored at time zero, 3 and 11 months after storage at 4° C. In this study, Fc-TMP was lyophilized at 0.5 mg/ml in the aforementioned formulation and in formulations with varying sucrose:mannitol ratios without Tween-20 added. In addition, stability was followed in the current formulation without Tween-20 and buffered at pH 4.5, 5 and 5.5. Results show that only the aforementioned formulation has minimal aggregation at pH 5. In formulations without Tween-20, aggregation varies from 0.5% to around 5%. Aggregation is also higher at pH 4.5 and 5.5 compared to that detected at pH 5. Lower sucrose:mannitol ratios (0.2, 0.5 and 1% sucrose formulations) have higher aggregation, as levels are typically around 5%. Over time, the level of aggregation remains consistent in the aforementioned formulation and in the formulation without Tween-20 through the 1 year timepoint.

TABLE 40

Fc-TMP in 10 mM Histidine, varied formulations, 0.5 mg/ml SEC-HPLC Measured Percent Aggregation

| Formulation | Time Zero | 3 Months | 11 Months[1] |
|---|---|---|---|
| 2% Sucrose, 4% Mannitol, pH 5.0 (with 0.004% Tween-20) | <0.1 | <0.1 | <0.1 |
| 2% Sucrose, 4% Mannitol, pH 4.5 | 2.4 | 2.9 | — |
| 2% Sucrose, 4% Mannitol, pH 5.0 | 0.5 | 1.6 | 0.8 |
| 2% Sucrose, 4% Mannitol, pH 5.5 | 2.3 | 2.5 | — |
| 0.2% Sucrose, 5.1% Mannitol, pH 5.0 | 4.8 | 7.3 | — |
| 0.5% Sucrose, 4.8% Mannitol, pH 5.0 | 5.1 | 4.4 | — |
| 1% Sucrose, 4.5% Mannitol, pH 5.0 | 4.5 | 4.3 | — |

[1]The optimized formulation samples were selected for evaluation at the 11 month timepoint.

Additional formulation studies were designed to confirm the beneficial effect of Tween-20 in minimizing aggregation. All of the samples in these studies were formulated at pH 5 with and without 0.004% Tween-20. Table 41 lists the percent aggregation after storage at 4° C. for time intervals of zero, 18 weeks and 1 year in stability. At time zero, immediately following lyophilization, aggregation is minimized in all of the samples with 0.004% Tween-20. Small amounts of aggregation are observed in samples without Tween-20, with the highest amount found in the formulation with 0.2% sucrose. The effectiveness of Tween-20 in minimizing aggregation also extends to the 18 week timepoint, with higher percent aggregation found in samples lacking Tween-20 and at low sucrose:mannitol ratios. After storage for one year at 4° C., aggregation is also consistently low in the samples containing Tween-20.

TABLE 41

Fc-TMP in 10 mM Histidine, varied formulations, 0.3 mg/ml, pH 5 SEC-HPLC Measured Percent Aggregation after Storage at 4° C.

| Formulation | Time Zero | 4 Months | 1 Year[1] |
|---|---|---|---|
| 2% Sucrose, 4% Mannitol (with 0.004% Tween-20) | <0.1 | 0.2 | <0.1 |
| 2% Sucrose, 4% Mannitol | 0.2 | 0.2 | — |
| 0.2% Sucrose, 5.1% Mannitol (with 0.004% Tween-20) | <0.1 | <0.1 | <0.1 |
| 0.2% Sucrose, 5.1% Mannitol | 1.1 | 1.3 | — |
| 0.5% Sucrose, 4.8% Mannitol (with 0.004% Tween-20) | <0.1 | 0.2 | <0.1 |
| 0.5% Sucrose, 4.8% Mannitol | 0.2 | 0.8 | — |
| 1% Sucrose, 4.5% Mannitol (with 0.004% Tween-20) | <0.1 | <0.1 | <0.1 |
| 1% Sucrose, 4.5% Mannitol | 0.1 | 0.3 | — |
| 1.5% Sucrose, 4.8% Mannitol (with 0.004% Tween-20) | <0.1 | <0.1 | <0.1 |
| 1.5% Sucrose, 4.8% Mannitol | 0.1 | 0.3 | — |

[1]Samples with Tween-20 were selected for evaluation at the 1 year timepoint.

Another stability study, designed to test the effectiveness of antioxidants in minimizing chemical degradation, reinforced the protective effect of Tween-20. Antioxidants did not have an impact in minimizing chemical degradation upon elevated temperature storage. However, the aforementioned formulation, with 0.004% Tween-20 and at an Fc-TMP concentration of 0.2 mg/ml, had <0.1% aggregation at time zero and 0.1% after 5 months storage at 4° C. The same formulation without Tween-20 had 0.4% aggregation at time zero and 1% aggregation after storage for 5 months.

The stability study results presented in Tables II, III and the aforementioned studies illustrate the protective effect of Tween-20 in minimizing aggregation upon lyophilization. The growth of aggregation over time is minimal, as timepoints extending to 1 year at 4° C. show no meaningful increases in aggregation in samples formulated with 0.004% Tween-20. Based on these stability study results which show that the addition of Tween-20 minimizes aggregation upon lyophilization, scale-up work was initiated with the recommended formulation.

Scale-Up Studies

Aggregation is Concentration Dependent

An initial scale-up study was designed to simulate manufacturing conditions and examine the robustness of the formulation with respect to shipping stress and stability upon reconstitution. Fc-TMP was buffer exchanged into the formulation buffer using a tangential flow filtration device, similar to larger scale processes. The protein was subsequently diluted to concentrations of 0.5 and 0.1 mg/ml with Tween-20 also added prior to the final filtration step. After samples were filled, lyophilization was performed. An exemplary lyophilzation process is set forth below:

| Thermal Treatment Steps | | | |
|---|---|---|---|
| | Temp | Time | Ramp/Hold |
| Step #1 | −50 | 120 | R |
| Step #2 | −50 | 120 | H |
| Step #3 | −13 | 60 | R |
| Step #4 | −13 | 360 | H |
| Step #5 | −50 | 60 | R |
| Step #6 | −50 | 60 | H |
| Freeze Temp | | −50 C. | |
| Additional Freeze | | 0 min | |
| Condenser Setpoint | | −60 C. | |
| Vacuum Setpoint | | 100 mTorr | |

| Primary Drying Steps | | | | |
|---|---|---|---|---|
| | temp | time | Vac | Ramp/Hold |
| Step #1 | −50 | 15 | 100 | H |
| Step #2 | −25 | 120 | 100 | R |
| Step #3 | −25 | 600 | 100 | H |
| Step #4 | −25 | 600 | 100 | H |
| Step #5 | 0 | 800 | 100 | R |
| Step #6 | 25 | 800 | 100 | R |
| Step #7 | 25 | 800 | 100 | H |
| Step #8 | 25 | 800 | 100 | H |
| Step #9 | 25 | 0 | 100 | H |
| Step #10 | 25 | 0 | 100 | H |
| Step #11 | 25 | 0 | 100 | H |
| Step #12 | 25 | 0 | 100 | H |
| Step #13 | 25 | 0 | 100 | H |
| Step #14 | 25 | 0 | 100 | H |
| Step #15 | 25 | 0 | 100 | H |
| Step #16 | 25 | 0 | 100 | H |
| Post Heat | 25 | 100 | 100 | H |

Secondary Temperature 28 C.

Passive storage at 4° C. resulted in more aggregation at the low Fc-TMP concentration (0.1 mg/ml). At time zero, aggregation was determined by SEC-HPLC to be 0.4% in the 0.1 mg/ml formulation, whereas 0.1% aggregation was detected in the protein formulated at 0.5 mg/ml. After six months storage at refrigerated temperature, the aggregation remained at the same levels as observed for the time zero samples for both concentrations of Fc-TMP, in agreement with results from previous stability studies. Due to the higher amount of aggregation observed at the lowest concentration (0.1 mg/ml) it was decided that 0.5 mg/ml would be best suited as the concentration of choice for additional scale-up work.

Aggregation does not Increase Upon Simulated Shear Stress

Lyophilized samples (not reconstituted) from the initial scale-up study were also subjected to simulated ground and air transportation with the aid of stress simulation equipment. Briefly, the protocol as outlined in the ASTM (American Society of Testing Methods), Method # D-4728, was followed. Simulated ground and air transportation was accomplished using an Electrodynamic Vibration Table, Model S202, and a Power Amplifier, Model # TA240 (Unholtz-Dickie Corporation, Wallingford, Conn.). Following the transportation stress, the physical appearance of the lyophilized cakes was compared to passive controls, with the result that no morphological changes of the cake were obvious. Both chemical and physical stability was acceptable, with aggregation consistent in the stressed samples and passive controls (<0.1% in the 0.5 mg/ml samples compared to 0.4% in the 0.1 mg/ml samples).

Stability upon reconstitution was examined in this study by preparing freshly reconstituted samples and incubating for 3, 7 and 14 days either passively, with slow tumbling, or vigorous shaking. Table 42 shows the results for the 0.1 and 0.5 mg/ml formulations. As is expected, the amount of aggregation is minimized in the formulations at 0.5 mg/ml. Compared to the slow tumbling over time vs. the non-tumbled samples, no meaningful increase in aggregation is apparent over the 14 day period. The amount of dimerization in these formulations (Non-tumbling and Tumbling) is also consistent. Interestingly, the shaking results appear to display a trend; i.e. the aggregation drops to less than detectable levels after time zero in both the 0.1 and 0.5 mg/ml samples. Meanwhile, there is a corresponding increase in the amount of dimerization observed in most shaken samples at each timepoint, suggesting that there is some reversibility in going from the aggregate to the dimer state upon shear stressing Fc-TMP.

TABLE 42

Fc-TMP in 10 mM Histidine, with 2% Sucrose, 4% Mannitol and 0.004% Tween-20, pH 5 SEC-HPLC Measured Percent Aggregation and Dimerization after Storage at 4° C.

| | Time Zero agg, dimer | 3 Days agg, dimer | 7 Days agg, dimer | 14 Days agg, dimer |
|---|---|---|---|---|
| 0.1 mg/ml | | | | |
| Non-Tumbling | 0.4, 0.3 | 1.2, 0.6 | 1.1, 0.4 | 1.0, 0.4 |
| Tumbling | 0.4, 0.3 | 0.7, 0.4 | 0.7, 0.3 | 1.1, 0.3 |
| Shaking | 0.4, 0.3 | <0.1, 0.9 | <0.1, 0.1 | <0.1, 1.6 |
| 0.5 mg/ml | | | | |
| Non-Tumbling | 0.1, 0.5 | 0.2, 0.5 | 0.2, 0.5 | 0.2, 0.6 |
| Tumbling | 0.1, 0.5 | 0.2, 0.6 | 0.1, 0.6 | 0.1, 0.6 |
| Shaking | 0.1, 0.5 | <0.1, 0.9 | <0.1, 1.0 | <0.1, 2.2 |

Secondary Drying for 12 Hours in the Lyophilization Cycle is Sufficient for Minimizing Residual Moisture A second scale-up study was performed in which Fc-TMP was buffer-exchanged and diluted to 0.5 mg/ml in the recommended formulation. Lyophilization was achieved with a cycle consisting of an initial freezing step at −50° C., followed by annealing at −13° C. The temperature was then ramped down to −50° C., held for an hour, and primary drying initiated at −50° C. with a vacuum setpoint of 100 mTorr. Following a brief hold period at −50 C, the temperature was ramped down to −25° C. over a two hour period, maintained at −25° C. for 20 hours, and then gradually raised to 25° C. after around 27 hours for the beginning of secondary drying. Secondary drying was continued for a minimum of 12 hours at 25° C. During the lyophilization cycle, samples were pulled after 12, 18 and 24 hours of secondary drying in order to check the stability and compare the level of residual moisture. Results show that residual moisture, as measured by Karl Fisher Titration, is around 0.6% or less (Table 43) in all samples examined. Moisture is similarly low in the buffer placebo cakes. Based on this work, the secondary drying time of the lyophilization cycle can be shortened to a range between 12-18 hours.

TABLE 43

Residual Moisture in Fc-TMP Secondary Drying Times Held at 12, 18 and 24 Hours

| Secondary Drying Time | Karl Fisher Percent Moisture |
|---|---|
| 12 hours | 0.23 |
| 12 hours | 0.38 |
| Buffer Placebo | 0.43 |
| 18 hours | 0.63 |
| 18 hours | 0.28 |

TABLE 43-continued

Residual Moisture in Fc-TMP
Secondary Drying Times Held at 12, 18 and 24 Hours

| Secondary Drying Time | Karl Fisher Percent Moisture |
|---|---|
| Buffer Placebo | 0.3 |
| 24 hours | 0.46 |
| 24 hours | 0.37 |
| Buffer Placebo | 0.31 |

Stability results are also comparable over this secondary drying time range, as samples do not have differences with respect to chemical or physical stability. For example, the amount of aggregation is <0.1% for all samples examined, while the percent dimer is consistently at 0.1%. These results confirm that the secondary drying time can be shortened to less than 24 hours without affecting the initial stability of the protein.

Additional work was performed to evaluate the robustness of the formulation with respect to varying excipient concentrations. Since previous stability work had shown that sucrose, for example, can have an impact on stability, it was necessary to examine the robustness of Fc-TMP upon minor changes in excipient levels.

Statistical Study of Fc-TMP

Robustness of Formulation

An initial statistical study had been designed to examine minor changes in formulation variables such as the formulation pH, histidine buffer strength and the sucrose:mannitol ratio, using an E-chip software package. These samples were lyophilized but a non-optimal freeze-dry cycle was used which resulted in higher aggregation than typically observed. The study was a screening study, assuming a linear response surface. Results of the stability assessment showed that the pH (4.7 to 5.3) and histidine buffer strength, (varied from 5 to 15 mM), had little impact on the stability of Fc-TMP. In order to verify the contribution of Tween-20 and the sucrose:mannitol ratio in the overall stability of Fc-TMP, a follow-up statistical design study was initiated using the more optimal lyophilization cycle.

Quadratic Statistical Stability Study

The second statistical design study examined variations in Tween-20 (0.001%, 0.0045% and 0.008%), the sucrose:mannitol ratio (1.7:4.2, 2:4 and 2.3:3.8), and variations in the protein concentration (0.3, 0.65 and 1 mg/ml). The pH of the formulations were also adjusted to 4.7, 5 and 5.3, and the Histidine buffer strength varied from 7, 10 and 13 mM. Samples were prepared and lyophilized using a Virtis lyophilizer (SP Industries, Inc., Gardiner, N.Y.), with an optimized conservative cycle used for the previous stability studies. Stability results were interpreted using E-chip (statistical design software package, Hockessin, Del.) in two ways: an assessment of the impact of formulation variables on the amount of aggregation and dimerization observed at time zero, and the effect of formulation variables in affecting elevated temperature (37° C.) storage stability as measured by rates of change from time zero.

Time Zero Formulation Results from Quadratic Statistical Study

Results from the time zero assessment showed that, as expected, Tween-20 minimizes aggregation, however the protein concentration was also significant in reducing the tendency to aggregate upon freeze-drying. The E-chip software program assesses the effects that different input variables (the formulation conditions) have on Fc-TMP aggregation and dimerization during freeze-drying. With respect to Fc-TMP dimerization at time zero, not one excipient of the formulation was considered (based on E-chip results) to have a significant effect. Several formulation variables impacted the amount of aggregation observed upon freeze-drying Fc-TMP. Based on the summary results provided by E-chip, the Fc-TMP concentration had the greatest effect on the degree of aggregation observed at time zero, followed by the Tween-20 level. Aggregation is observed to be the highest, at time zero, in the low concentration samples. Likewise, higher amounts of Tween-20 have more of a protective effect in minimizing aggregation at time zero, although this trend is not as meaningful as the protein concentration effect. Higher amounts of aggregation were observed in this study compared to previous study results, and around 0.5% aggregation was observed in some samples at the lower protein concentrations with Tween-20.

It was observed that the variability in aggregation drops as the protein concentration increases. At 0.5 mg/ml and higher concentrations, Fc-TMP has average lower aggregation than in samples formulated at or below 0.3 mg/ml.

Tween-20 at 0.004% is Effective in Minimizing Aggregation upon Elevated Temperature Storage The Statistical Design study was also used to assess changes upon elevated temperature storage. Rates of aggregation were compared in the varied formulation conditions after 16 days at 37° C. by subtracting the elevated temperature results from the initial (time zero) results and normalizing to one month's time. Rates which are negative thus refer to an apparent loss of the measured property over time. Response variables (corresponding to results from assays) were determined through RP-HPLC (percent main-peak purity and pre-peak percent), cation-exchange HPLC (percent main-peak purity), size-exclusion HPLC (aggregation and dimer formation) and NIR-water (residual moisture by infra-red spectroscopy, which was correlated with Karl Fisher Titration results in some samples to verify accuracy).

Results from a comparison of the rates of change obtained from each assay technique show that changes in aggregation and RP-HPLC oxidation were statistically significant with respect to the Fc-TMP concentration and Tween-20 squared concentration, to within two standard deviations. The Tween-20 squared term most likely arises from the quadratic nature of the study which assumes a curved response surface. In this case, the squared Tween-20 term fits the model better, in addition to possibly suggesting that there is an interactive effect with itself which affects stability. The other measured responses, such as cation-exchange HPLC main-peak purity, or the varied pH conditions, for example, did not exhibit any significant responses in affecting protein stability.

As is the case with the initial scale-up study previously discussed (tumbled, non-tumbled and shaken samples), the amount of aggregation is lower after high temperature storage. The rate of change in these samples was used to make predictions based on the statistical model (quadratic study) to anticipate the protective effect of Tween-20. Table 44 shows predictions for the amount of aggregation expected, based on the statistical design model, as the Tween-20 concentration is raised from 0 to 0.008%. As is shown, the rate of aggregation, normalized to one month at 37° C., is negative (indicating the loss of aggregate in these conditions) with the exception of 0% Tween-20, in which case aggregation would be predicted to grow. The rate of loss of aggregate appears to plateau at Tween-20 concentrations of 0.002% and higher, suggesting that Tween-20 at low levels (0.002-0.006%) is sufficient in minimizing physical degradation. The rate of growth of dimer is correspondingly similar under these conditions and was not statistically correlated with any of the formulation excipients, as previously mentioned.

TABLE 44

Statistical Quadratic Model Predictions
Varied Tween-20 and Fc-TMP Concentration
Based on 16 Days Incubation at 37° C. (normalized to one month)

| % Tween 20 | Fc-TMP (mg/ml) | % SEC Aggregation | prediction limits | % RP-HPLC Oxidation | prediction limits |
|---|---|---|---|---|---|
| 0 | 0.5 | 0.09 | (−0.32, 0.50) | 0.47 | (−2.59, 1.65) |
| 0.002 | 0.5 | −0.35 | (−0.69, −0.0) | −0.68 | (−2.44, 1.08) |
| 0.004 | 0.5 | −0.53 | (−0.87, −0.19) | −0.58 | (−2.32, 1.17) |
| 0.006 | 0.5 | −0.45 | (−0.78, −0.12) | −0.17 | (−1.86, 1.52) |
| 0.008 | 0.5 | −0.12 | (−0.46, 0.21) | 0.54 | (−1.18, 2.26) |
| 0.004 | 0.3 | −0.59 | (−0.94, −0.25) | 0.58 | (−1.18, 2.34) |
| 0.004 | 0.1 | −0.63 | (−1.10, −0.16) | 2.69 | (0.28, 5.09) |

The rate of change in RP-HPLC measured oxidation at 0.5 mg/ml, assuming that this corresponds to changes in the pre-peak region of each chromatogram, is not statistically significant with respect to the Tween-20 squared term. In this case, the model (as shown in Table 44) predicts that as the Tween-20 concentration is varied the rate of oxidation is consistent with the limits of the prediction intervals. The protein concentration affects oxidation, as the rate of growth increases from 0.58 to 2.69 as the protein concentration drops from 0.3 to 0.1 mg/ml (while keeping the Tween-20 constant at 0.004%.).

These results suggest that maintaining the Tween-20 concentration between 0.002 to 0.006% is desirable from a stability standpoint. The amount of protein is also important, as the stability is worse at concentrations below 0.5 mg/ml.

Refrigerated Temperature Stability

Considering the above, the following formulation was used for assessing the refrigerated temperature stability of lyophilized Fc-TMP: 0.5 mg/ml Fc-TMP in 10 mM Histidine buffered at pH 5, 2% Sucrose, 4% Mannitol, and 0.004% Tween-20.

The formulation was monitored for refrigerated temperature stability for a period of one year. Table 45 shows the stability results from this study, with results from time zero, 3 months and 1 year listed. As is shown, the percent main peak purity, as measured by Reversed-Phase and Cation-Exchange HPLC, does not appear to decrease with time. The minor differences in main-peak purity over time are typical of the normal variation in resolution of the chromatographic columns and are also observed in the frozen standard. The percent aggregation is consistent and does not appear to grow after one year.

TABLE 45

| | Timepoint | | |
|---|---|---|---|
| Concentration | 0 | 3 months | 1 Year |
| Reversed-Phase HPLC Percent Main Peak | | | |
| 0.3 | 81.0 | 82.5 | 82.4 |
| 0.5 | 69.0 | 82.7 | 83.4 |
| 1.0 | 80.6 | 82.4 | 83.2 |
| Frozen Starting Material | 82.4 | 84.0 | 84.5 |
| Cation-Exchange HPLC Percent Main Peak | | | |
| 0.3 | 67.0 | 71.8 | 81.8 |
| 0.5 | 73.5 | 83.1 | 80.0 |
| 1.0 | 74.2 | 79.7 | 80.5 |
| Frozen Starting Material | 75.3 | 77.0 | 83.6 |

TABLE 45-continued

| | Timepoint | | |
|---|---|---|---|
| Concentration | 0 | 3 months | 1 Year |
| Size-Exclusion HPLC Percent Aggregation | | | |
| 0.3 | <0.1 | 0.1 | 0.1 |
| 0.5 | <0.1 | <0.1 | 0.1 |
| 1.0 | <0.1 | <0.1 | <0.1 |
| Frozen Starting Material | 0.1 | 0.1 | <0.1 |

Fc-TMP is formulated in 10 mM Histidine, buffered at pH 5.0 with 2% sucrose, 4% mannitol and 0.004% Tween-20. It has been shown that pH 5 is more optimal for stability, and that the sucrose:mannitol ratio is critical in minimizing chemical degradation upon storage at elevated temperature for this protein system. Tween-20 is needed at a low concentration in order to minimize the amount of aggregation which occurs as a result of the lyophilization-process. Stability studies for scale-up applications support these conclusions. Statistical studies have also been designed which validate the level of each excipient in the formulation, including the need for the protein concentration to be at 0.5 mg/ml. Refrigerated temperature stability of the recommended formulation does not show meaningful degradation after storage for one year at 4° C.

Example 8

Lyophilized Fc-Ang-2 Binding Peptide

In order to determine the optimal formulation for lyophilized Fc-Ang-2 binding peptide, analyses were carried out that assessed Fc-Ang-2 binding peptide aggregation and stability at various pH values, excipient concentrations, and protein concentrations.

Fc-Ang-2 binding peptide consists of two pharmaceutically active polypeptide molecules linked to the C-terminus of the Fc portion of an IgG1 antibody molecule. The molecule is comprised of 574 amino acid residues with a total molecular weight of 63,511 Daltons. The pI of the molecule is 5.45. There are two disulfide bonds on each of the active polypeptides. There are a total of 20 cysteine residues throughout the molecule, most of which are oxidized in disulfide bridges. The sequence of Fc-Ang-2 binding peptide is as follows:

(SEQ ID NO: 2)
MDKTHTCPPCPAPELLGGPSVFLFPPKPKDTLMISRTPEVTCVVVDVSHE

DPEVKFNWYVDGVEVHNAKTKPREEQYNSTYRVVSVLTVLHQDWLNGKEY

KCKVSNKALPAPIEKTISKAKGQPREPQVYTLPPSRDELTKNQVSLTCLV

-continued
KGFYPSDIAVEWESNGQPENNYKTTPPVLDSDGSFFLYSKLTVDKSRWQQ

GNVFSCSVMHEALHNHYTQKSLSLSPGKGGGGAQQEECEWDPWTCEHMG

SGSATGGSGSTASSGSGSATHQEECEWDPWTCEHMLE

The Fc portion of the IgG1 terminates at K228. G229-G233 composes a linker sequence. The active polypeptide begins at A234 and extends to the rest of the sequence.

Lyophilized Fc-Ang-2 Binding Peptide pH Screen

The pH screen tested the stability of an Fc-Ang-2 binding peptide at pH 4.0, 7.0, and 8.0. At pH 4.0, the screened buffers included glutamic acid, sodium citrate, and sodium succinate, each at a concentration of 10 mM. At pH 7.0, the screened buffers were histidine and tris, both at 10 mM concentration. Hisitidine and Tris were also screened at pH 8.0, each at 10 mM. Each of the buffers contained 4% mannitol as a lyophilization caking agent and 2% sucrose as an excipient. In addition, the histidine buffer at pH 7.0 was examined with and without the presence of a surfactant, 0.01% Tween 20 (w/w). The protein was diluted to 5 mg/ml with each of the formulation buffers. This solution was then dialyzed into each of the formulation buffers using dialysis tubing with a 10,000 Da molecular weight exclusion limit, where a total of 6 exchanges were performed with a minimum of 4 hours of equilibration between exchanges. After dialysis, the protein was aliquoted into 3 cc glass vials with a 1 ml fill volume. These vials were then lyophilized using a lab-scale freeze-drying instrument. After lyophilization, the vials were sealed and stored for incubation at 4° C., 29° C., and 37° C., where individual vials were pulled and analyzed at various points over time, beginning immediately after lyophilization and extending out to a period of 24 months. The samples were reconstituted with the appropriate volume of water and analyzed for protein stability using size exclusion liquid chromatography and gel electrophoresis (which detect aggregation, dimerization and proteolytic cleavage), anion exchange liquid chromatography (which detects oxidation). In addition, the properties of the cake such as reconstitution times and moisture and properties of the reconstituted liquid solution were analyzed (such as pH).

Lyophilized Fc-Ang-2 Binding Peptide Excipient Study

The excipient screen was performed in a single buffer, 10 mM hisitidine at pH 7.0. The two excipients compared in this study were 0.85% arginine and 1% sucrose. The caking agent used with arginine was 4% mannitol, and the caking agent used with sucrose was 2% glycine. Each of the formulations was tested at protein concentrations of 1 mg/ml, 30 mg/ml, and 60 mg/ml. In addition, one formulation containing a manntiol sucrose combination was tested at 30 mg/ml. Each of the formulations contained 0.01% Tween 20. The protein was first concentrated to 70 mg/ml and dialyzed into the appropriate formulation using a lab-scale ultrafiltration/diafiltration device. The protein was then diluted to each of the three concentrations with the appropriate formulation buffer. The protein was then aliquoted into 3 cc glass vials with a fill volume of 1 ml. The vials were then lyophilized using a lab-scale freeze-drying instrument. After lyophilization, the vials were sealed and stored for incubation at 4° C., 29° C., 37° C., and 52° C., where individual vials were pulled and analyzed at various points over time, beginning immediately after lyophilization and extending out to a period of 24 months. The samples were analyzed for protein stability using size exclusion chromatography, anion exchange chromatography and SDS-PAGE. The properties of the lyophilized cake and reconstituted liquid solutions were also analyzed.

Lyophilized Fc-Ang-2 Binding Peptide Concentration Screen

The concentration screen was performed in 10 mM histidine at pH 7.2, with 4% mannitol as the caking agent and 2% sucrose as an excipient. The protein was concentrated to approximately 140 mg/ml and dialyzed into the formulation using a lab-scale ultrafiltration/diafiltration device. The dialyzed protein was then diluted to 30 mg/ml, 60 mg/ml, and 120 mg/ml in the formulation buffer. The solutions were then aliquoted into 3 cc glass vials at a fill volume of 1 ml. The vials were lyophilized using a lab-scale freeze-drying instrument. After lyophilization, the vials were sealed and stored for incubation at 4° C., 29° C., 37° C., and 52° C., where individual vials were pulled and analyzed at various points over time, beginning immediately after lyophilization and extending out to a period of 24 months. The samples were analyzed for protein stability using size exclusion chromatography, anion exchange chromatography and SDS-PAGE. The properties of the lyophilized cake and reconstituted liquid solutions were also analyzed.

Conclusion

Considering the above, the optimal formulation(s) comprises 10 mM histidine, 4% mannitol, 2% sucrose, 0.01% Tween-20, pH 7.0.

Example 9

Lyophilized Fc-Agp-3 Binding Peptide

In order to determine the optimal formulation for lyophilized Fc-Agp-3 binding peptide, analyses were carried out that assessed Fc-Agp-3 binding peptide aggregation and stability at various pH values, excipient concentrations, and protein concentrations.

Fc-Agp-3 binding peptide is a N-linked peptibody against the B cell activation factor (BAFF) aimed against B cell-related diseases. The peptibody is constructed of two non-glycosylated disulfide-linked polypeptides with a total mass of ~63.6 kD. The isoelectric point for this peptibody has been estimated to be pH 7.36.

Fc SEQUENCE (SEQ ID NO: 1696):

VDKTHTCPPCPAPELLGGPSVFLFP

PKPKDTLMISRTPEVTCVVVDVSHE

DPEVKFNWYVDGVEVHNAKTKPREE

QYNSTYRVVSVLTVLHQDWLNGKEY

KCKVSNKALPAPIEKTISKAKGQPR

EPQVYTLPPSRDELTKNQVSLTCLV

KGFYPSDIAVEWESNGQPENNYKTT

PPVLDSDGSFFLYSKLTVDKSRWQQ

GNVFSCSVMHEALHNHYTQKSLSLS

PGK

Agp-3 Binding Peptide Sequence (SEQ ID NO: 1697):

G C K W D L L I K Q W V C D P L G S G S A T G G S
G S T A S S G S G S A T H M L P G C K W D L L I K
Q W V C D P L G G G G

Thus, the sequence of Fc-Agp-3 binding peptide binding peptide is as follows:

(SEQ ID NO: 1698)
G C K W D L L I K Q W V C D P L G S G S A T G G S
G S T A S S G S G S A T H M L P G C K W D L L I K
Q W V C D P L G G G G V D K T H T C P P C P A P
E L L G G P S V F L F P P K P K D T L M I S R T P
E V T C V V V D V S H E D P E V K F N W Y V D G V
E V H N A K T K P R E E Q Y N S T Y R V V S V L T
V L H Q D W L N G K E Y K C K V S N K A L P A P I
E K T I S K A K G Q P R E P Q V Y T L P P S R D E
L T K N Q V S L T C L V K G F Y P S D I A V E W E
S N G Q P E N N Y K T T P P V L D S D G S F F L Y
S K L T V D K S R W Q Q G N V F S C S V M H E A L
H N H Y T Q K S L S L S P G K

Lyophilized Fc-Agp-3 Binding Peptide Broad pH Screen at 10 mg/Ml

The stability was assessed primarily by size-exclusion HPLC (SE-HPLC), which was stability-indicating at elevated temperatures. To assess the stability and reconstitution properties of lyophilized Fc-Agp-3 binding peptide over the pH range of 3.85-7.6, 10 mg/mL Fc-Agp-3 binding peptide was formulated in various 10 mM buffers in the presence of 2.5% mannitol and 2.0% sucrose. The following buffers were tested at approximately 0.5 pH unit increments: acetate, succinate, histidine, pyrophosphate, phosphate and Tris.

For the formulation development work, purified bulk material was obtained in the 30 mg/mL frozen liquid formulation. The material was dialyzed into the appropriate formulation buffers and lyophilized in a Virtis lyophilizer using a conservative cycle. The annealing step was performed at −20° C. and lasted for 4 hours to allow for mannitol crystallization. The primary drying was performed at the shelf temperature of −25° C. for 20 hours. The primary drying reached completion at −25° C. since no spike in the vacuum was observed as the shelf temperature was increased up to 0° C. No major collapse was observed and the samples proceeded successfully through the secondary drying first at 0° C., and then at 25° C. Upon reconstitution the formulations with pH at or above 7 were slightly turbid, while all the other formulations were clear. This was explained by the proximity of the high pH formulations to the isoelectric point of Fc-Agp-3 binding peptide (pI=7.36). SE-HPLC analysis revealed a dimer as the main high molecular weight specie. It was observed that relative % dimer was strongly pH dependent with the lowest accumulation at pH 5 and below. The amount of soluble aggregates also showed some pH dependence. No soluble aggregates were observed in the samples prior to lyophilization. In contrast, a small amount of dimer was present in all formulations prior to lyophilization, and it increased further in the reconstituted samples, post lyophilization. No significant clipping was observed in all formulations. The highest amount of the intact monomer was in the case of acetate, succinate and histidine formulations at pH 5 and below.

Lyophilized Fc-Agp-3 Binding Peptide Broad pH Screen at 30 mg/ml: Stabilizing Effect of Sucrose and Mannitol The stability was assessed primarily by size-exclusion HPLC (SE-HPLC), which was stability-indicating. To evaluate the effect of the presence of 2.5% mannitol and 3.5% sucrose on stability and reconstitution properties of lyophilized Fc-Agp-3 binding peptide over the pH range of 4.5-7.5, Fc-Agp-3 binding peptide was formulated at 30 mg/mL in 10 mM succinate, histidine and phosphate buffers. Pyrophosphate and Tris buffers were excluded from this study due to poor performance in the previous broad pH screen. Acetate buffer was excluded due to possibility of pH changes in the reconstituted samples as a result of acetate sublimation during freeze-drying.

For the formulation development work, purified bulk material was obtained in the 30 mg/mL frozen liquid formulation. The material was dialyzed into the appropriate formulation buffers and lyophilized in a Virtis lyophilizer using a conservative cycle. The annealing step was performed at −20° C. and lasted for 5 hours to allow for more complete mannitol crystallization. The primary drying was performed at the shelf temperature of −25° C. for 20 hours. The primary drying not quite reached completion at −25° C., and some spike in the vacuum was observed as the shelf temperature was increased up to 0° C. No major collapse was observed and the samples proceeded successfully through the secondary drying first at 0° C., and then at 25° C. Upon reconstitution formulations with pH around 7 were slightly turbid, while all other formulations were clear. As it was mentioned previously, this could be explained by the proximity of the high pH formulations to the isoelectric point of Fc-Agp-3 binding peptide. SE-HPLC analysis revealed dimer as the main high molecular weight specie. Again, it was observed that relative % dimer was strongly pH dependent with the lowest accumulation at pH 5 and below. The amount of soluble aggregates did not show clear pH dependence. No soluble aggregates were observed in the samples prior to lyophilization. ~0.6% dimer was observed in the non-GMP bulk prior to formulating and it increased up to 3.0% for high pH formulations prior to lyophilization as a result of buffer exchange/concentration.

The pH dependence of the dimer accumulation was also confirmed by close correspondence of the relative amount dimer at a given pH irrespective of the type of buffer. % dimer did not increase significantly post-lyophilization as evidenced by T=0 samples. The only exception were the samples non-containing both, sucrose and mannitol, which showed noticeable, ~0.25-0.5% increase in % dimer. In the presence of sucrose the main peak loss was minimal even after buffer exchange/lyophilization for succinate and histidine formulations with pH 4.1 and 4.7, respectively. Compared to them, all phosphate formulations showed ~3% loss of the main peak prior to lyophilization. Although, the cake was formed even in the absence of both sucrose and mannitol, the corresponding main peak dropped by 0.5-0.7% compared to the sugar-containing formulations. In addition, reconstitution of the non-sugar formulations was much longer (>2 min) and required some agitation. In order to ensure robustness of the cake mannitol or glycine were included as bulking agents in all subsequent formulations even though sucrose alone was shown to confer sufficient protein stability.

Lyophilized Fc-Agp-3 Binding Peptide Narrow pH Screen at 30 mg/ml The stability was assessed primarily by size-exclusion HPLC (SE-HPLC) and reversed-phase HPLC (RP-HPLC), which were stability-indicating at elevated temperatures. Since % recovery of the main peak was higher at pH 5 and below, the phosphate buffer was omitted from the narrow pH screen. In addition to the succinate and histidine buffers, which performed well in the broad pH screens, the narrow pH screen included 10 mM glutamate, pH 4-6. The formulations were tested at 0.2 pH unit increments. The sucrose and mannitol content was kept constant at 3.5% and 2.5%, respectively, except for two succinate formulations at pH 4.5 with 2.0% and 5.0% sucrose. Also, six potential generic lyo formulations were tested at every pH unit increments, such as:
1) 20 mM histidine, 2.0% glycine, 1.0% sucrose at pH 5.0
2) 20 mM histidine, 2.0% glycine, 1.0% sucrose at pH 6.0
3) 20 mM histidine, 2.0% glycine, 1.0% sucrose at pH 7.0
4) 20 mM histidine, 4.0% mannitol, 2.0% sucrose at pH 5.0
5) 20 mM histidine, 4.0% mannitol, 2.0% sucrose at pH 6.0
6) 20 mM histidine, 4.0% mannitol, 2.0% sucrose at pH 7.0

For the formulation development work, purified bulk material was obtained in the 30 mg/mL frozen liquid formulation. The material was dialyzed into the appropriate formulation buffers and lyophilized in a Virtis lyophilizer using a conservative cycle. The lyophilization cycle was further modified. The annealing step was performed at −15° C. to allow for glycine crystallization and lasted for 5 hours. The primary drying was performed initially at −30° C. for a short period of time (4 h). Then the shelf temperature was raised to −25° C. and kept constant for 24 hours. However, primary drying did not quite reach completion at −25° C. as evidenced by a small spike in the vacuum as the shelf temperature was further increased up to 0° C. Nevertheless, no major collapse was observed and the samples proceeded successfully through the secondary drying first at 0° C., and then at 25° C. Up to 6 months lyophilized state stability data was generated at 37° C. to assess long-term stability of Fc-Agp-3 binding peptide. Increase in pH results in the loss of the main peak for all histidine formulations. Only generic formulations were monitored up to 6 months, but the advantage of the pH near 5.0 was already obvious for the 1- and 3-month timepoints. Moreover, 6-month data for the generic formulations suggests that mannitol+sucrose formulations are more stable than glycine+sucrose, especially at pH 6 and higher.

In the case of glutamate and succinate formulations there was also a clear pH-dependent increase in the amount of dimer, the main degradation product, as pH becomes less acidic. Similar pH dependence is seen for the aggregates. The highest recovery of the main peak was observed for pH 5 and below. Initial loss of the main peak for T=0 can be explained by protein degradation during buffer exchange and concentrating as evidenced by a similar loss for the formulations prior to lyophilization. However, 3-month stability data suggest that glutamate formulations had higher physical stability than their succinate counterparts (with the same pH). It has to be noted that in this study we also tested effect of increased sucrose concentrations on the stability of succinate formulations. In addition to 3.5% sucrose, we compared 2.0% and 5.0% sucrose formulations in succinate, pH 4.5. The increase in sucrose decreased high molecular weight species to some extent, but it did not significantly affect the amount of the main peak. Therefore, 3.5% sucrose was considered optimal since such formulations most closely matched with physiological tonicity.

One of clip specie was observed growing at low pH by RP-HPLC. A significant portion of the pH-dependent clipping in the lyophilized formulations occurred prior to lyophilization as a result of time-consuming buffer exchange and protein concentrating steps. After lyophilization no significant increase in the amount of clips was observed even after 3- to 6-month storage at 37° C. In general the data suggests using higher pH formulations to mitigate the clipping since it is unobservable at pH 6 and above. However, the amount of the dimer is significant at higher pH and may be as high as 2.5-4.5% at pH 6 and above. Therefore, a compromise can be found in formulating Fc-Agp-3 binding peptide at pH 5, where clipping is moderate, especially in the glutamate and histidine buffers, and when the dimer formation is still sufficiently suppressed.

Conclusion 2.5% mannitol and 3.5% sucrose have provided sufficient cake and protein stability as confirmed by 6-month shelf study at 37° C. Therefore, 10 mM histidine, 2.5% mannitol, 3.5% sucrose at pH 5.0 and 10 mM glutamate, 2.5% mannitol, 3.5% sucrose at pH 5.0 can be used for formulating 30 mg/mL Fc-Agp-3 binding peptide. In addition, this study shows that 20 mM histidine, 4.0% mannitol, 2.0% sucrose at pH 5.0 also performs well and can be considered as a possible generic lyo formulation for peptibodies.

Example 10

Lyophilized Fc-Myo Binding Peptide

In order to determine the optimal formulation for lyophilized Fc-Myo binding peptide, analyses were carried out that assessed Fc-Myo binding peptide aggregation and stability at various pH values, excipient concentrations, and protein concentrations.

Fc-Myo binding peptide is a C-linked peptibody against the myostatin protein aimed against muscle wasting-related diseases. The peptibody is constructed of two non-glycosylated disulfide-linked polypeptides with a total mass of ~59.1 kD. The isoelectric point for this peptibody has been estimated to be pH 6.88.

Fc Sequence (SEQ ID NO:1699):

M D K T H T C P P C P A P E L L G G P S V F L F P
P K P K D T L M I S R T P E V T C V V V D V S H E
D P E V K F N W Y V D G V E V H N A K T K P R E E
Q Y N S T Y R V V S V L T V L H Q D W L N G K E Y
K C K V S N K A L P A P I E K T I S K A K G Q P R
E P Q V Y T L P P S R D E L T K N Q V S L T C L V
K G F Y P S D I A V E W E S N G Q P E N N Y K T T
P P V L D S D G S F F L Y S K L T V D K S R W Q Q
G N V F S C S V M H E A L H N H Y T Q K S L S L S
P G K

Myostatin Binding Peptide Sequence (SEQ ID NO:1700):

G G G G G A Q L A D H G Q C I R W P W M C P P E G
W E

Thus, the sequence of Fc-Myo binding peptide binding peptide is as follows:

(SEQ ID NO: 1701)
M D K T H T C P P C P A P E L L G G P S V F L F P

P K P K D T L M I S R T P E V T C V V V D V S H E

D P E V K F N W Y V D G V E V H N A K T K P R E E

Q Y N S T Y R V V S V L T V L H Q D W L N G K E Y

K C K V S N K A L P A P I E K T I S K A K G Q P R

E P Q V Y T L P P S R D E L T K N Q V S L T C L V

K G F Y P S D I A V E W E S N G Q P E N N Y K T T

P P V L D S D G S F F L Y S K L T V D K S R W Q Q

G N V F S C S V M H E A L H N H Y T Q K S L S L S

P G K G G G G A Q L A D H G Q C I R W P W M C P

P E G W E

Determination of pH Condition for Lyophilized Fc-Myo Binding Peptide

The stability was assessed primarily by size-exclusion HPLC (SE-HPLC), which was stability-indicating at elevated temperatures. A pH screen study was designed and performed to determine the optimal formulation pH in the liquid state prior to the lyophilization. Protein was formulated in pH 4.5, 4.75, 5.0, 5.5 and 6.0 with buffer agents of acetate and histidine and sucrose as the stabilizer (or lyo protectant). The formulated vials were stored at 29 C for up to 1 year. Stability was monitored using SE-HPLC. The aggregation rate constants were calculated for each of the formulation conditions. The aggregation rate at pH 4.5 was found to be the minimum, therefore pH 4.5 was selected as the preferred formulation pH condition.

Lyophilized Fc-Myo Binding Peptide Buffer Agent Study at 30 mg/mL.

The stability was assessed primarily by size-exclusion HPLC (SE-HPLC), which was stability-indicating. A 30 mg/mL dosage form as investigated using three different buffering agent: 10 mM glutamate, 10 mM histidine and 10 mM succinate at pH 4.5. All formulations contain 0.004% polysorbate 20.

For the formulation development work, purified bulk material was obtained in the 30 mg/mL frozen liquid formulation. The material was dialyzed into the appropriate formulation buffers and lyophilized in a Virtis lyophilizer using a conservative cycle. Lyophilized protein formulation displayed acceptable cake elegance. Upon reconstitution formulations were clear Lyophilized Fc-Myo binding peptide was stored at 4, 29, 37 and 52° C. The real time stability studies were carried out at 4° C. and found to be comparable for these formulations for up to 3 months. However at 52° C. storage 3 months, the histidine containing formulation was slightly better than the glutamate containing formulation. The succinate containing formulation was significantly less stable than the other two formulations. Based on these results, histidine and glutamate were considered as the preferred buffer agents for the final Fc-Myo binding peptide formulation.

Lyophilized Fc-Myo Binding Peptide Excipient Study at 30 mg/ml: Stabilizing Effect of Sucrose, Trehalose and Hydroxyethyl Starch The stability was assessed primarily by size-exclusion HPLC (SE-HPLC), which was stability-indicating. To evaluate the effect of the presence of trehalose, hydroxyethyl starch and sucrose on stability of lyophilized Fc-Myo binding peptide, Fc-Myo binding peptide was formulated at 30 mg/mL in 10 mM glutamate buffer with 4% mannitol. The concentration of trehalose and sucrose used was 2.0%, 1% hydroxyethyl starch was added to the sucrose formulation to make a final formulation of 10 mM glutamate, 4% mannitol, 2% sucrose, 1% hydroxyethyl starch. All formulations contain 0.004% polysorbate 20.

For the formulation development work, purified bulk material was obtained in the 30 mg/mL frozen liquid formulation. The material was dialyzed into the appropriate formulation buffers and lyophilized in a Virtis lyophilizer using a conservative cycle. Lyophilized protein formulation displayed acceptable cake elegance. Upon reconstitution formulations were clear.

The stability of these formulations was monitored using SE-HPLC.

Lyophilized Fc-Myo binding peptide was stored at 4, 29, 37 and 52° C. The real time shelf time condition stability (4° C.) was found comparable between these formulations for up to 3 months. However under 52° C. storage condition for 3 months, the sucrose containing formulation was slightly better than the trehalose containing formulation. Addition of hydroxyethyl starch did not display any negative impact on the stability. Based on these results, sucrose was considered as the preferred stabilizer for the final Fc-Myo binding peptide formulation.

Lyophilized Fc-Myo Binding Peptide Excipient Study at 30 mg/Ml: Stabilizing Effect of Sucrose and Mannitol The stability was assessed primarily by size-exclusion HPLC (SE-HPLC), which was stability-indicating. To evaluate the effect of the presence of variable amount of mannitol and sucrose on stability and reconstitution properties of lyophilized Fc-Myo binding peptide over the mannitol range of 4.0 to 8% and the sucrose range of 1.0% to 4.0%, Fc-Myo binding peptide was formulated at 30 mg/mL in 10 mM glutamate buffer. All formulations contain 0.004% polysorbate 20.

For the formulation development work, purified bulk material was obtained in the 30 mg/mL frozen liquid formulation. The material was dialyzed into the appropriate formulation buffers and lyophilized in a Virtis lyophilizer using a conservative cycle. Lyophilized protein formulation displayed acceptable cake elegance. Upon reconstitution formulations were clear.

The stability of these formulations was monitored using SE-HPLC method. Lyophilized Fc-Myo binding peptide was stored at 4, 29, 37 and 52° C. The real time shelf time condition stability (4° C.) was found comparable between these formulations for up to 3 months. However when stored at 52° C. for 3 months, an increasing amount of sucrose was found contributing to the increase in stability against aggregation. Due to a concern to maintain the isotonic condition for the final formulation which limits the total amount of disaccharides and to maintain a proper ratio of mannitol and sucrose to preserve the lyophilized cake property, 4.0% mannitol and 2.0% sucrose were the preferred excipients for the final formulation.

Lyophilized Fc-Myo Binding Peptide Excipient Study at 1, 30, 85 mg/mL

The stability was assessed primarily by size-exclusion HPLC (SE-HPLC), which was stability-indicating. To evaluate the effect of the protein concentration on stability and reconstitution properties of lyophilized Fc-Myo binding peptide, Fc-Myo binding peptide was formulated at 1, 30, 85 mg/mL in 10 mM glutamate buffer with 4% mannitol and 2% sucrose. All formulations contain 0.004% polysorbate 20.

For the formulation development work, purified bulk material was obtained in the 30 mg/mL frozen liquid formulation. The material was buffer exchanged into the appropriate formulation buffers using UF/DF and lyophilized in a Virtis lyophilizer using a conservative cycle. Lyophilized protein formulation displayed acceptable cake elegance. Upon reconstitution formulations were clear.

The stability of these formulations was monitored using SE-HPLC method. Lyophilized Fc-Myo binding peptide was stored at 4, 29, 37° C. The real time shelf time condition stability (4° C.) was found comparable between these formulations for up to 6 months. The stability is likely acceptable for all the concentrations studied as the commercial product formulation.

Conclusion 4.0% mannitol and 2.0% sucrose have provided sufficient cake and protein stability as confirmed by 12-month shelf study at 4° C. Therefore, 10 mM histidine, 4.0% mannitol, 2.0% sucrose at pH 4.5 and 10 mM glutamate, 4.0% mannitol, 2.0% sucrose at pH 4.5 can be used for formulating 1 to 100 mg/mL Fc-Myo binding peptide.

The present invention has been described in terms of particular embodiments found or proposed to comprise preferred modes for the practice of then invention. It will be appreciated by those of ordinary skill in the art that, in light of the present disclosure, numerous modifications and changes can be made in the particular embodiments exemplified without departing from the intended scope of the invention.

Applicant hereby incorporates by reference the material contained on the (2) Compact Discs submitted in this application, each containing a single copy of the Sequence Listing. Compact Disc 1 is named Written Sequence Listing on Compact Disc (Copy 1 Replacement 09/12/2007), the date of creation is 09/12/2007, size in bytes of 544 KB (557,056 bytes) and the name of the file contained on Compact Disc of A-1122-US-NP.txt. Compact Disc 2 is named Written Sequence Listing on Compact Disc (Copy 2 Replacement 09/12/2007), the date of creation is 09/12/2007, size in bytes of 544 KB (557,056 bytes) and the name of the file contained on Compact Disc of A-1122-US-NP.txt.

SEQUENCE LISTING (1704 sequences)

SEQ ID NO: 1 - protein, 227 aa, Artificial sequence
  Synthetic peptide
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 287 aa, Artificial sequence
  Synthetic peptide
MDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGAQQEECEWDPWTCEHMGSGSATGGSGSTASSGSGSATHQEECEWDPWTCEHMLE

SEQ ID NO: 3 - protein, 9 aa, Artificial sequence
  Synthetic peptide
  Misc feature (1)..(1): Xaa=Val, Leu, Ile, Glu, Pro, Gly, Tyr, Met, Thr or Asp
  Misc feature (2)..(2): Xaa=Tyr, Trp or Phe
  Misc feature (3)..(3): Xaa=Glu, Phe, Val, Trp or Tyr
  Misc feature (4)..(5): If residue 5 is not Pro, azetidine is between residues 4 and 5
  Misc feature (5)..(5): Xaa=Pro or nothing
  Misc feature (7)..(7): Xaa=Ser, Ala, Val or Leu
  Misc feature (8)..(8): Xaa=Met, Phe, Val, Arg, Gln, Lys, Thr, Ser, Asp, Leu, Ile or Glu
  Misc feature (9)..(9): Xaa=Glu, Leu, Trp, Val, His, Ile, Gly, Ala, Asp, Leu, Tyr, Asn, Gln or Pro
XXXQXYXXX

SEQ ID NO: 4 - protein, 8 aa, Artificial sequence
  Synthetic peptide
  Misc feature (1)..(2): Xaa can be any naturally occurring amino acid
  Misc feature (3)..(4): If residue 4 is not Pro, azetidine is between residues 3 and 4
  Misc feature (4)..(4): Xaa=Pro or nothing
  Misc feature (6)..(6): Xaa=Ser, Ala, Val or Leu
  Misc feature (7)..(8): Xaa can be any naturally occurring amino acid
XXQXYXXX

SEQ ID NO: 5 - protein, 8 aa, Artificial sequence
  Synthetic peptide
  Misc feature (1)..(1): Xaa=Tyr, Trp or Phe
  Misc feature (2)..(2): Xaa can be any naturally occurring amino acid
  Misc feature (3)..(4): If residue 4 is not Pro, azetidine is between residues 3 and 4
  Misc feature (4)..(4): Xaa=Pro or nothing
  Misc feature (6)..(6): Xaa=Ser, Ala, Val or Leu
  Misc feature (7)..(8): Xaa can be any naturally occurring amino acid
XXQXYXXX

SEQ ID NO: 6 - protein, 8 aa, Artificial sequence
  Synthetic peptide
  Misc feature (1)..(1): Xaa=Tyr, Trp or Phe
  Misc feature (2)..(2): Xaa=Glu, Phe, Val, Trp or Tyr
  Misc feature (3)..(4): If residue 4 is not Pro, azetidine is between residues 3 and 4
  Misc feature (4)..(4): Xaa=Pro or nothing
  Misc feature (6)..(6): Xaa=Ser, Ala, Val or Leu
  Misc feature (7)..(7): Xaa=Met, Phe, Val, Arg, Gln, Lys, Thr, Ser, Asp, Leu, Ile or Glu
  Misc feature (8)..(8): Xaa=Glu, Leu, Trp, Val, His, Ile, Gly, Ala, Asp, Leu, Tyr, Asn, Gln or Pro
XXQXYXXX

SEQ ID NO: 7 - protein, 9 aa, Artificial sequence
  Synthetic peptide
  Misc feature (1)..(1): Xaa=Val, Leu, Ile, Glu, Pro, Gly, Tyr, Met, Thr or Asp
  Misc feature (2)..(2): Xaa=Tyr, Trp or Phe
  Misc feature (3)..(3): Xaa=Glu, Phe, Val, Trp or Tyr
  Misc feature (4)..(5): If residue 5 is not Pro, azetidine is between residues 4 and 5
  Misc feature (5)..(5): Xaa=Pro or nothing
  Misc feature (7)..(7): Xaa=Ser, Ala, Val or Leu
  Misc feature (8)..(8): Xaa=Met, Phe, Val, Arg, Gln, Lys, Thr, Ser, Asp, Leu, Ile or Glu
  Misc feature (9)..(9): Xaa=Glu, Leu, Trp, Val, His, Ile, Gly, Ala, Asp, Leu, Tyr, Asn, Gln or Pro
XXXQXYXXX

SEQ ID NO: 8 - protein, 21 aa, Artificial sequence
  Synthetic peptide
  Misc feature (1)..(1): Xaa=Ala, Asp, Glu, Phe, Gly, Lys, Gln, Ser, Thr or Tyr
  Misc feature (2)..(2): Xaa=Ala, Asp, Gly, Ile, Asn, Pro, Ser, Thr, Val or Trp
  Misc feature (3)..(3): Xaa=Ala, Asp, Gly, Leu, Asn, Pro, Ser, Thr, Trp or Tyr
  Misc feature (4)..(4): Xaa=Ala, Asp, Glu, Phe, Leu, Asn, Arg, Val or Tyr
  Misc feature (5)..(5): Xaa=Ala, Asp, Glu, Gln, Arg, Ser or Thr
  Misc feature (6)..(6): Xaa=His, Ile, Leu, Pro, Ser, Thr or Trp
  Misc feature (7)..(7): Xaa=Ala, Glu, Phe, Lys, Asn, Gln, Arg, Ser or Tyr
  Misc feature (8)..(8): Xaa=Asp, Glu, Phe, Gln, Arg, Thr or Trp
  Misc feature (9)..(9): Xaa=Ala, Asp, Pro, Ser, Thr or Trp
  Misc feature (10)..(10): Xaa=Ala, Asp, Gly, Lys, Asn, Gln, Ser or Thr
  Misc feature (11)..(11): Xaa=Ala, Glu, Leu, Pro, Ser, Thr, Val or Tyr
  Misc feature (12)..(12): Xaa=Val, Leu, Ile, Glu, Pro, Gly, Tyr, Met, Thr or Asp
  Misc feature (13)..(13): Xaa=Tyr, Trp or Phe
  Misc feature (14)..(14): Xaa=Glu, Phe, Val, Trp or Tyr
  Misc feature (15)..(16): If residue 16 is not Pro, azetidine is between residues 15 and 16
  Misc feature (16)..(16): Xaa=Pro or nothing
  Misc feature (18)..(18): Xaa=Ser, Ala, Val or Leu
  Misc feature (19)..(19): Xaa=Met, Phe, Val, Arg, Gln, Lys, Thr, Ser, Asp, Leu, Ile or Glu
  Misc feature (20)..(20): Xaa=Glu, Leu, Trp, Val, His, Ile, Gly, Ala, Asp, Leu, Tyr, Asn, Gln or Pro
XXXXXXXXXXXXXXQXYXXXL

SEQ ID NO: 9 - protein, 11 aa, Artificial sequence
  Synthetic peptide
  Misc feature (1)..(1): Xaa=Asp or Tyr
  Misc feature (3)..(3): Xaa=Asp, Ser or Thr
  Misc feature (4)..(4): Xaa=Ser, Thr or Ala
  Misc feature (5)..(5): Xaa=Ser or Trp
  Misc feature (6)..(6): Xaa=Ser or Tyr
  Misc feature (7)..(7): Xaa=Asp, Gln, Glu or Val
  Misc feature (8)..(8): Xaa=Asn, Ser, Lys, His or Trp
  Misc feature (9)..(9): Xaa=Phe or Leu
  Misc feature (10)..(10): Xaa=Asp, Asn, Ser or Leu
  Misc feature (11)..(11): Xaa=Leu, Ile, Gln, Met or Ala
XNXXXXXXXXX

SEQ ID NO: 10 - protein, 21 aa, Artificial sequence
  Synthetic peptide
TANVSSFEWTPYYWQPYALPL

SEQ ID NO: 11 - protein, 18 aa, Artificial sequence
  Synthetic peptide
SWTDYGYWQPYALPISGL

SEQ ID NO: 12 - protein, 21 aa, Artificial sequence
  Synthetic peptide
ETPFTWEESNAYYWQPYALPL

SEQ ID NO: 13 - protein, 21 aa, Artificial sequence
  Synthetic peptide
ENTYSPNWADSMYWQPYALPL

SEQ ID NO: 14 - protein, 21 aa, Artificial sequence
  Synthetic peptide
SVGEDHNFWTSEYWQPYALPL

SEQ ID NO: 15 - protein, 21 aa, Artificial sequence
  Synthetic peptide
DGYDRWRQSGERYWQPYALPL

SEQ ID NO: 16 - protein, 11 aa, Artificial sequence
  Synthetic peptide
FEWTPGYWQPY

SEQ ID NO: 17 - protein, 11 aa, Artificial sequence
  Synthetic peptide
FEWTPGYWQHY

SEQ ID NO: 18 - protein, 10 aa, Artificial sequence
  Synthetic peptide
  Misc feature (9)..(10): Azetidine is between residues 9 and 10
FEWTPGWYQY

SEQ ID NO: 19 - protein, 10 aa, Artificial sequence
  Synthetic peptide
  Acetylation (1)..(1): Acetylated phenylalanine at position 1
  Misc feature (9)..(10): Azetidine is between positions 9 and 10
FEWTPGWYQY

SEQ ID NO: 20 - protein, 11 aa, Artificial sequence
  Synthetic peptide
  Phosphorylation (8)..(8): Phosphorylated Tyr at position 8
  Misc feature (10)..(11): Azetidine is between residues 10 and 11
FEWTPGWYYQY

SEQ ID NO: 21 - protein, 10 aa, Artificial sequence
  Synthetic peptide
  Misc feature (9)..(10): Azetidine is between residues 9 and 10
FAWTPGYWQY

SEQ ID NO: 22 - protein, 10 aa, Artificial sequence
  Synthetic peptide
  Misc feature (9)..(10): Azetidine is between residues 9 and 10
FEWAPGYWQY

SEQ ID NO: 23 - protein, 10 aa, Artificial sequence
  Synthetic peptide
  Misc feature (9)..(10): Azetidine is between residues 9 and 10
FEWVPGYWQY

SEQ ID NO: 24 - protein, 10 aa, Artificial sequence
  Synthetic peptide
  Misc feature (9)..(10): Azetidine is between residues 9 and 10
FEWTPGYWQY

SEQ ID NO: 25 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGYWQY

SEQ ID NO: 26 - protein, 10 aa, Artificial sequence
  Synthetic peptide
  Misc feature (9)..(10): Azetidine is between residues 9 and 10
FEWTPAWYQY

SEQ ID NO: 27 - protein, 10 aa, Artificial sequence
  Synthetic peptide
  Misc feature (6)..(6): Xaa=Sarcosine
  Misc feature (9)..(10): Azetidine is between residues 9 and 10
FEWTPXWYQY

SEQ ID NO: 28 - protein, 11 aa, Artificial sequence
  Synthetic peptide
FEWTPGYYQPY

SEQ ID NO: 29 - protein, 11 aa, Artificial sequence
  Synthetic peptide
FEWTPGWWQPY

SEQ ID NO: 30 - protein, 11 aa, Artificial sequence
  Synthetic peptide
FEWTPNYWQPY

SEQ ID NO: 31 - protein, 10 aa, Artificial sequence
  Synthetic peptide
  Misc feature (9)..(10): Azetidine is between residues 9 and 10
FEWTPVYWQY

SEQ ID NO: 32 - protein, 9 aa, Artificial sequence
  Synthetic peptide
  Misc feature (4)..(5): Pipecolic acid is between residues 4 and 5
  Misc feature (8)..(9): Azetidine is between residues 8 and 9
FEWTGYWQY

SEQ ID NO: 33 - protein, 9 aa, Artificial sequence
  Synthetic peptide
  Misc feature (5)..(6): Aminoisobutyric acid is between residues 5 and 6
  Misc feature (8)..(9): Azetidine is between residues 8 and 9
FEWTPYWQY

SEQ ID NO: 34 - protein, 10 aa, Artificial sequence
  Synthetic peptide
  Misc feature (5)..(5): Xaa=Sarcosine
  Misc feature (9)..(10): Azetidine is between residues 9 and 10
FEWTXGYWQY

SEQ ID NO: 35 - protein, 11 aa, Artificial sequence
  Synthetic peptide
FEWTPGYWQPY

SEQ ID NO: 36 - protein, 11 aa, Artificial sequence
  Synthetic peptide
FEWTPGYWQHY

SEQ ID NO: 37 - protein, 10 aa, Artificial sequence
  Synthetic peptide
  Misc feature (9)..(10): Azetidine is between residues 9 and 10
FEWTPGWYQY

SEQ ID NO: 38 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGWYQY

SEQ ID NO: 39 - protein, 10 aa, Artificial sequence
  Synthetic peptide
  Phosphorylation (8)..(8): Phosphorylated Tyr at position 8
  Misc feature (9)..(10): Azetidine is between residues 9 and 10
FEWTPGWYQY

SEQ ID NO: 40 - protein, 10 aa, Artificial sequence
  Synthetic peptide
  Misc feature (9)..(10): Azetidine is between residues 9 and 10
FAWTPGYWQY

SEQ ID NO: 41 - protein, 10 aa, Artificial sequence
  Synthetic peptide
  Misc feature (9)..(10): Azetidine is between residues 9 and 10
FEWAPGYWQY

SEQ ID NO: 42 - protein, 10 aa, Artificial sequence
  Synthetic peptide
  Misc feature (9)..(10): Azetidine is between residues 9 and 10
FEWVPGYWQY

SEQ ID NO: 43 - protein, 10 aa, Artificial sequence
  Synthetic peptide
  Misc feature (9)..(10): Azetidine is between residues 9 and 10
FEWTPGYWQY

SEQ ID NO: 44 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGYWQY

SEQ ID NO: 45 - protein, 10 aa, Artificial sequence
  Synthetic peptide
  Misc feature (6)..(6): D-Ala
  Misc feature (9)..(10): Azetidine is between residues 9 and 10
FEWTPAWYQY

SEQ ID NO: 46 - protein, 10 aa, Artificial sequence
  Synthetic peptide
  Misc feature (6)..(6): Xaa=Sarcosine
  Misc feature (9)..(10): Azetidine is between residues 9 and 10
FEWTPXWYQY

SEQ ID NO: 47 - protein, 11 aa, Artificial sequence
  Synthetic peptide
FEWTPGYYQPY

SEQ ID NO: 48 - protein, 11 aa, Artificial sequence
  Synthetic peptide
FEWTPGWWQPY

SEQ ID NO: 49 - protein, 11 aa, Artificial sequence
  Synthetic peptide
FEWTPNYWQPY

SEQ ID NO: 50 - protein, 10 aa, Artificial sequence
  Synthetic peptide
  Misc feature (6)..(6): D-Val
  Misc feature (9)..(10): Azetidine is between residues 9 and 10
FEWTPVYWQY

SEQ ID NO: 51 - protein, 9 aa, Artificial sequence
  Synthetic peptide
  Misc feature (4)..(5): Pipecolic acid is between residues 4 and 5
  Misc feature (8)..(9): Azetidine is between residues 8 and 9
FEWTGYWQY

SEQ ID NO: 52 - protein, 9 aa, Artificial sequence
  Synthetic peptide
  Misc feature (5)..(6): Aminoisobutyric acid is between residues 5 and 6
  Misc feature (8)..(9): Azetidine is between residues 8 and 9
FEWTPYWQY

SEQ ID NO: 53 - protein, 10 aa, Artificial sequence
  Synthetic peptide
  Misc feature (5)..(5): Xaa=Sarcosine
  Misc feature (9)..(10): Azetidine is between residues 9 and 10
FEWTXGYWQY

SEQ ID NO: 54 - protein, 15 aa, Artificial sequence
  Synthetic peptide
FEWTPGYWQPYALPL

SEQ ID NO: 55 - protein, 10 aa, Artificial sequence
  Synthetic peptide
  MISC_FEATURE (1)..(1): Ala modified to 1-naphthylalanine at position 1
  MISC_FEATURE (9)..(10): Azetidine is between residues 9 and 10
AEWTPGYYQY

SEQ ID NO: 56 - protein, 10 aa, Artificial sequence
  Synthetic peptide
  Misc feature (9)..(10): Azetidine is between residues 9 and 10
YEWTPGYYQY

SEQ ID NO: 57 - protein, 10 aa, Artificial sequence
  Synthetic peptide
  Misc feature (9)..(10): Azetidine is between residues 9 and 10
FEWVPGYYQY

SEQ ID NO: 58 - protein, 10 aa, Artificial sequence
  Synthetic peptide
  Misc feature (6)..(6): D-Ser
  Misc feature (9)..(10): Azetidine is between residues 9 and 10
FEWTPSYYQY

SEQ ID NO: 59 - protein, 10 aa, Artificial sequence
  Synthetic peptide
  Misc feature (6)..(6): D-Asn
  Misc feature (9)..(10): Azetidine is between residues 9 and 10
FEWTPNYYQY

SEQ ID NO: 60 - protein, 4 aa, Artificial sequence
  Synthetic peptide
TKPR

SEQ ID NO: 61 - protein, 5 aa, Artificial sequence
  Synthetic peptide
RKSSK

SEQ ID NO: 62 - protein, 5 aa, Artificial sequence
  Synthetic peptide
RKQDK

SEQ ID NO: 63 - protein, 6 aa, Artificial sequence
  Synthetic peptide
NRKQDK

SEQ ID NO: 64 - protein, 6 aa, Artificial sequence
  Synthetic peptide
RKQDKR

SEQ ID NO: 65 - protein, 9 aa, Artificial sequence
  Synthetic peptide
ENRKQDKRF

SEQ ID NO: 66 - protein, 6 aa, Artificial sequence
  Synthetic peptide
VTKFYF

SEQ ID NO: 67 - protein, 5 aa, Artificial sequence
  Synthetic peptide
VTKFY

SEQ ID NO: 68 - protein, 5 aa, Artificial sequence
  Synthetic peptide
VTDFY

SEQ ID NO: 69 - protein, 11 aa, Artificial sequence
  Synthetic peptide
SHLYWQPYSVQ

SEQ ID NO: 70 - protein, 12 aa, Artificial sequence
  Synthetic peptide
TLVYWQPYSLQT

SEQ ID NO: 71 - protein, 12 aa, Artificial sequence
  Synthetic peptide
RGDYWQPYSVQS

SEQ ID NO: 72 - protein, 12 aa, Artificial sequence
  Synthetic peptide
VHVYWQPYSVQT

SEQ ID NO: 73 - protein, 12 aa, Artificial sequence
  Synthetic peptide
RLVYWQPYSVQT

SEQ ID NO: 74 - protein, 12 aa, Artificial sequence
  Synthetic peptide
SRVWFQPYSLQS

SEQ ID NO: 75 - protein, 12 aa, Artificial sequence
  Synthetic peptide
NMVYWQPYSIQT

SEQ ID NO: 76 - protein, 12 aa, Artificial sequence
  Synthetic peptide
SVVFWQPYSVQT

SEQ ID NO: 77 - protein, 12 aa, Artificial sequence
  Synthetic peptide
TFVYWQPYALPL

SEQ ID NO: 78 - protein, 12 aa, Artificial sequence
  Synthetic peptide
TLVYWQPYSIQR

SEQ ID NO: 79 - protein, 12 aa, Artificial sequence
  Synthetic peptide
RLVYWQPYSVQR

SEQ ID NO: 80 - protein, 12 aa, Artificial sequence
  Synthetic peptide
SPVFWQPYSIQI

SEQ ID NO: 81 - protein, 12 aa, Artificial sequence
  Synthetic peptide
WIEWWQPYSVQS

SEQ ID NO: 82 - protein, 12 aa, Artificial sequence
  Synthetic peptide
SLIYWQPYSLQM

SEQ ID NO: 83 - protein, 12 aa, Artificial sequence
  Synthetic peptide
TRLYWQPYSVQR

SEQ ID NO: 84 - protein, 12 aa, Artificial sequence
  Synthetic peptide
RCDYWQPYSVQT

SEQ ID NO: 85 - protein, 12 aa, Artificial sequence
  Synthetic peptide
MRVFWQPYSVQN

SEQ ID NO: 86 - protein, 12 aa, Artificial sequence
  Synthetic peptide
KIVYWQPYSVQT

SEQ ID NO: 87 - protein, 12 aa, Artificial sequence
  Synthetic peptide
RHLYWQPYSVQR

SEQ ID NO: 88 - protein, 12 aa, Artificial sequence
  Synthetic peptide
ALVWWQPYSEQI

SEQ ID NO: 89 - protein, 12 aa, Artificial sequence
  Synthetic peptide
SRVWFQPYSLQS

SEQ ID NO: 90 - protein, 10 aa, Artificial sequence
  Synthetic peptide
WEQPYALPLE

SEQ ID NO: 91 - protein, 12 aa, Artificial sequence
  Synthetic peptide
QLVWWQPYSVQR

SEQ ID NO: 92 - protein, 12 aa, Artificial sequence
  Synthetic peptide
DLRYWQPYSVQV

SEQ ID NO: 93 - protein, 12 aa, Artificial sequence
  Synthetic peptide
ELVWWQPYSLQL

SEQ ID NO: 94 - protein, 12 aa, Artificial sequence
  Synthetic peptide
DLVWWQPYSVQW

SEQ ID NO: 95 - protein, 12 aa, Artificial sequence
  Synthetic peptide
NGNYWQPYSFQV

SEQ ID NO: 96 - protein, 12 aa, Artificial sequence
  Synthetic peptide
ELVYWQPYSIQR

SEQ ID NO: 97 - protein, 12 aa, Artificial sequence
  Synthetic peptide
ELMYWQPYSVQE

SEQ ID NO: 98 - protein, 12 aa, Artificial sequence
  Synthetic peptide
NLLYWQPYSMQD

SEQ ID NO: 99 - protein, 12 aa, Artificial sequence
  Synthetic peptide
GYEWYQPYSVQR

SEQ ID NO: 100 - protein, 12 aa, Artificial sequence
  Synthetic peptide
SRVWYQPYSVQR

SEQ ID NO: 101 - protein, 12 aa, Artificial sequence
  Synthetic peptide
LSEQYQPYSVQR

SEQ ID NO: 102 - protein, 12 aa, Artificial sequence
  Synthetic peptide
GGGWWQPYSVQR

SEQ ID NO: 103 - protein, 12 aa, Artificial sequence
  Synthetic peptide
VGRWYQPYSVQR

SEQ ID NO: 104 - protein, 12 aa, Artificial sequence
  Synthetic peptide
VHVYWQPYSVQR

SEQ ID NO: 105 - protein, 12 aa, Artificial sequence
  Synthetic peptide
QARWYQPYSVQR

SEQ ID NO: 106 - protein, 12 aa, Artificial sequence
  Synthetic peptide
VHVYWQPYSVQT

SEQ ID NO: 107 - protein, 12 aa, Artificial sequence
  Synthetic peptide
RSVYWQPYSVQR

SEQ ID NO: 108 - protein, 12 aa, Artificial sequence
  Synthetic peptide
TRVWFQPYSVQR

SEQ ID NO: 109 - protein, 12 aa, Artificial sequence
  Synthetic peptide
GRIWFQPYSVQR

SEQ ID NO: 110 - protein, 12 aa, Artificial sequence
  Synthetic peptide
GRVWFQPYSVQR

SEQ ID NO: 111 - protein, 12 aa, Artificial sequence
  Synthetic peptide
ARTWYQPYSVQR

SEQ ID NO: 112 - protein, 12 aa, Artificial sequence
  Synthetic peptide
ARVWWQPYSVQM

SEQ ID NO: 113 - protein, 12 aa, Artificial sequence
  Synthetic peptide
RLMFYQPYSVQR

SEQ ID NO: 114 - protein, 12 aa, Artificial sequence
  Synthetic peptide
ESMWYQPYSVQR

SEQ ID NO: 115 - protein, 12 aa, Artificial sequence
  Synthetic peptide
HFGWWQPYSVHM

SEQ ID NO: 116 - protein, 12 aa, Artificial sequence
  Synthetic peptide
ARFWWQPYSVQR

SEQ ID NO: 117 - protein, 12 aa, Artificial sequence
  Synthetic peptide
RLVYWQPYAPIY

SEQ ID NO: 118 - protein, 12 aa, Artificial sequence
  Synthetic peptide
RLVYWQPYSYQT

SEQ ID NO: 119 - protein, 12 aa, Artificial sequence
  Synthetic peptide
RLVYWQPYSLPI

SEQ ID NO: 120 - protein, 12 aa, Artificial sequence
  Synthetic peptide
RLVYWQPYSVQA

SEQ ID NO: 121 - protein, 12 aa, Artificial sequence
  Synthetic peptide
SRVWYQPYAKGL

SEQ ID NO: 122 - protein, 12 aa, Artificial sequence
  Synthetic peptide
SRVWYQPYAQGL

SEQ ID NO: 123 - protein, 12 aa, Artificial sequence
  Synthetic peptide
SRVWYQPYAMPL

SEQ ID NO: 124 - protein, 12 aa, Artificial sequence
  Synthetic peptide
SRVWYQPYSVQA

SEQ ID NO: 125 - protein, 12 aa, Artificial sequence
  Synthetic peptide
SRVWYQPYSLGL

SEQ ID NO: 126 - protein, 12 aa, Artificial sequence
  Synthetic peptide
SRVWYQPYAREL

SEQ ID NO: 127 - protein, 12 aa, Artificial sequence
  Synthetic peptide
SRVWYQPYSRQP

SEQ ID NO: 128 - protein, 12 aa, Artificial sequence
  Synthetic peptide
SRVWYQPYFVQP

SEQ ID NO: 129 - protein, 12 aa, Artificial sequence
  Synthetic peptide
EYEWYQPYALPL

SEQ ID NO: 130 - protein, 12 aa, Artificial sequence
  Synthetic peptide
IPEYWQPYALPL

SEQ ID NO: 131 - protein, 12 aa, Artificial sequence
  Synthetic peptide
SRIWWQPYALPL

SEQ ID NO: 132 - protein, 12 aa, Artificial sequence
  Synthetic peptide
DPLFWQPYALPL

SEQ ID NO: 133 - protein, 12 aa, Artificial sequence
  Synthetic peptide
SRQWVQPYALPL

SEQ ID NO: 134 - protein, 12 aa, Artificial sequence
  Synthetic peptide
IRSWWQPYALPL

SEQ ID NO: 135 - protein, 11 aa, Artificial sequence
  Synthetic peptide
RGYWQPYALPL

SEQ ID NO: 136 - protein, 12 aa, Artificial sequence
  Synthetic peptide
RLLWVQPYALPL

SEQ ID NO: 137 - protein, 12 aa, Artificial sequence
  Synthetic peptide
EYRWFQPYALPL

SEQ ID NO: 138 - protein, 12 aa, Artificial sequence
  Synthetic peptide
DAYWVQPYALPL

SEQ ID NO: 139 - protein, 12 aa, Artificial sequence
  Synthetic peptide
WSGYFQPYALPL

SEQ ID NO: 140 - protein, 12 aa, Artificial sequence
  Synthetic peptide
NIEFWQPYALPL

SEQ ID NO: 141 - protein, 12 aa, Artificial sequence
  Synthetic peptide
TRDWVQPYALPL

SEQ ID NO: 142 - protein, 12 aa, Artificial sequence
  Synthetic peptide
DSSWYQPYALPL

SEQ ID NO: 143 - protein, 12 aa, Artificial sequence
  Synthetic peptide
IGNWYQPYALPL

SEQ ID NO: 144 - protein, 12 aa, Artificial sequence
  Synthetic peptide
NLRWDQPYALPL

SEQ ID NO: 145 - protein, 12 aa, Artificial sequence
  Synthetic peptide
LPEFWQPYALPL

SEQ ID NO: 146 - protein, 12 aa, Artificial sequence
  Synthetic peptide
DSYWWQPYALPL

SEQ ID NO: 147 - protein, 12 aa, Artificial sequence
  Synthetic peptide
RSQYYQPYALPL

SEQ ID NO: 148 - protein, 12 aa, Artificial sequence
  Synthetic peptide
ARFWLQPYALPL

SEQ ID NO: 149 - protein, 12 aa, Artificial sequence
  Synthetic peptide
NSYFWQPYALPL

SEQ ID NO: 150 - protein, 12 aa, Artificial sequence
  Synthetic peptide
RFMYWQPYSVQR

SEQ ID NO: 151 - protein, 12 aa, Artificial sequence
  Synthetic peptide
AHLFWQPYSVQR

SEQ ID NO: 152 - protein, 9 aa, Artificial sequence
  Synthetic peptide
WWQPYALPL

SEQ ID NO: 153 - protein, 9 aa, Artificial sequence
  Synthetic peptide
YYQPYALPL

SEQ ID NO: 154 - protein, 9 aa, Artificial sequence
  Synthetic peptide
YFQPYALGL

SEQ ID NO: 155 - protein, 10 aa, Artificial sequence
  Synthetic peptide
YWYQPYALPL

SEQ ID NO: 156 - protein, 10 aa, Artificial sequence
  Synthetic peptide
RWWQPYATPL

SEQ ID NO: 157 - protein, 10 aa, Artificial sequence
  Synthetic peptide
GWYQPYALGF

SEQ ID NO: 158 - protein, 10 aa, Artificial sequence
  Synthetic peptide
YWYQPYALGL

SEQ ID NO: 159 - protein, 10 aa, Artificial sequence
  Synthetic peptide
IWYQPYAMPL

SEQ ID NO: 160 - protein, 10 aa, Artificial sequence
  Synthetic peptide
SNMQPYQRLS

SEQ ID NO: 161 - protein, 20 aa, Artificial sequence
  Synthetic peptide
TFVYWQPYAVGLPAAETACN

SEQ ID NO: 162 - protein, 20 aa, Artificial sequence
  Synthetic peptide
TFVYWQPYSVQMTITGKVTM

SEQ ID NO: 163 - protein, 20 aa, Artificial sequence
  Synthetic peptide
  Misc feature (12)..(13): Xaa can be any naturally occurring amino acid
  Misc feature (16)..(16): Xaa can be any naturally occurring amino acid
TFVYWQPYSSHXXVPXGFPL

SEQ ID NO: 164 - protein, 20 aa, Artificial sequence
  Synthetic peptide
TFVYWQPYYGNPQWAIHVRH

SEQ ID NO: 165 - protein, 20 aa, Artificial sequence
  Synthetic peptide
TFVYWQPYVLLELPEGAVRA

SEQ ID NO: 166 - protein, 20 aa, Artificial sequence
  Synthetic peptide
TFVYWQPYVDYVWPIPIAQV

SEQ ID NO: 167 - protein, 11 aa, Artificial sequence
  Synthetic peptide
GWYQPYVDGWR

SEQ ID NO: 168 - protein, 12 aa, Artificial sequence
  Synthetic peptide
RWEQPYVKDGWS

SEQ ID NO: 169 - protein, 12 aa, Artificial sequence
  Synthetic peptide
EWYQPYALGWAR

SEQ ID NO: 170 - protein, 10 aa, Artificial sequence
  Synthetic peptide
GWWQPYARGL

SEQ ID NO: 171 - protein, 12 aa, Artificial sequence
  Synthetic peptide
LFEQPYAKALGL

SEQ ID NO: 172 - protein, 12 aa, Artificial sequence
  Synthetic peptide
GWEQPYARGLAG

SEQ ID NO: 173 - protein, 12 aa, Artificial sequence
  Synthetic peptide
AWVQPYATPLDE

SEQ ID NO: 174 - protein, 12 aa, Artificial sequence
  Synthetic peptide
MWYQPYSSQPAE

SEQ ID NO: 175 - protein, 12 aa, Artificial sequence
  Synthetic peptide
GWTQPYSQQGEV

SEQ ID NO: 176 - protein, 12 aa, Artificial sequence
  Synthetic peptide
DWFQPYSIQSDE

SEQ ID NO: 177 - protein, 11 aa, Artificial sequence
  Synthetic peptide
PWIQPYARGFG

SEQ ID NO: 178 - protein, 12 aa, Artificial sequence
  Synthetic peptide
RPLYWQPYSVQV

SEQ ID NO: 179 - protein, 12 aa, Artificial sequence
  Synthetic peptide
TLIYWQPYSVQI

SEQ ID NO: 180 - protein, 12 aa, Artificial sequence
  Synthetic peptide
RFDYWQPYSDQT

SEQ ID NO: 181 - protein, 12 aa, Artificial sequence
  Synthetic peptide
WHQFVQPYALPL

SEQ ID NO: 182 - protein, 17 aa, Artificial sequence
  Synthetic peptide
EWDSVYWQPYSVQTLLR

SEQ ID NO: 183 - protein, 17 aa, Artificial sequence
  Synthetic peptide
WEQNVYWQPYSVQSFAD

SEQ ID NO: 184 - protein, 16 aa, Artificial sequence
  Synthetic peptide
SDVVYWQPYSVQSLEM

SEQ ID NO: 185 - protein, 17 aa, Artificial sequence
  Synthetic peptide
YYDGVYWQPYSVQVMPA

SEQ ID NO: 186 - protein, 12 aa, Artificial sequence
  Synthetic peptide
SDIWYQPYALPL

SEQ ID NO: 187 - protein, 12 aa, Artificial sequence
  Synthetic peptide
QRIWWQPYALPL

SEQ ID NO: 188 - protein, 12 aa, Artificial sequence
  Synthetic peptide
SRIWWQPYALPL

SEQ ID NO: 189 - protein, 12 aa, Artificial sequence
  Synthetic peptide
RSLYWQPYALPL

SEQ ID NO: 190 - protein, 12 aa, Artificial sequence
  Synthetic peptide
TIIWEQPYALPL

SEQ ID NO: 191 - protein, 12 aa, Artificial sequence
  Synthetic peptide
WETWYQPYALPL

SEQ ID NO: 192 - protein, 12 aa, Artificial sequence
  Synthetic peptide
SYDWEQPYALPL

SEQ ID NO: 193 - protein, 12 aa, Artificial sequence
  Synthetic peptide
SRIWCQPYALPL

SEQ ID NO: 194 - protein, 12 aa, Artificial sequence
  Synthetic peptide
EIMFWQPYALPL

SEQ ID NO: 195 - protein, 12 aa, Artificial sequence
  Synthetic peptide
DYVWQQPYALPL

SEQ ID NO: 196 - protein, 15 aa, Artificial sequence
  Synthetic peptide
MDLLVQWYQPYALPL

SEQ ID NO: 197 - protein, 15 aa, Artificial sequence
  Synthetic peptide
GSKVILWYQPYALPL

SEQ ID NO: 198 - protein, 15 aa, Artificial sequence
  Synthetic peptide
RQGANIWYQPYALPL

SEQ ID NO: 199 - protein, 15 aa, Artificial sequence
  Synthetic peptide
GGGDEPWYQPYALPL

SEQ ID NO: 200 - protein, 15 aa, Artificial sequence
  Synthetic peptide
SQLERTWYQPYALPL

SEQ ID NO: 201 - protein, 15 aa, Artificial sequence
  Synthetic peptide
ETWVREWYQPYALPL

SEQ ID NO: 202 - protein, 15 aa, Artificial sequence
  Synthetic peptide
KKGSTQWYQPYALPL

SEQ ID NO: 203 - protein, 15 aa, Artificial sequence
  Synthetic peptide
LQARMNWYQPYALPL

SEQ ID NO: 204 - protein, 15 aa, Artificial sequence
  Synthetic peptide
EPRSQKWYQPYALPL

SEQ ID NO: 205 - protein, 15 aa, Artificial sequence
  Synthetic peptide
VKQKWRWYQPYALPL

SEQ ID NO: 206 - protein, 15 aa, Artificial sequence
  Synthetic peptide
LRRHDVWYQPYALPL

SEQ ID NO: 207 - protein, 15 aa, Artificial sequence
  Synthetic peptide
RSTASIWYQPYALPL

SEQ ID NO: 208 - protein, 15 aa, Artificial sequence
  Synthetic peptide
ESKEDQWYQPYALPL

SEQ ID NO: 209 - protein, 15 aa, Artificial sequence
  Synthetic peptide
EGLTMKWYQPYALPL

SEQ ID NO: 210 - protein, 15 aa, Artificial sequence
  Synthetic peptide
EGSREGWYQPYALPL

SEQ ID NO: 211 - protein, 12 aa, Artificial sequence
  Synthetic peptide
VIEWWQPYALPL

SEQ ID NO: 212 - protein, 12 aa, Artificial sequence
  Synthetic peptide
VWYWEQPYALPL

SEQ ID NO: 213 - protein, 12 aa, Artificial sequence
  Synthetic peptide
ASEWWQPYALPL

SEQ ID NO: 214 - protein, 12 aa, Artificial sequence
  Synthetic peptide
FYEWWQPYALPL

SEQ ID NO: 215 - protein, 12 aa, Artificial sequence
  Synthetic peptide
EGWWVQPYALPL

SEQ ID NO: 216 - protein, 12 aa, Artificial sequence
  Synthetic peptide
WGEWLQPYALPL

SEQ ID NO: 217 - protein, 12 aa, Artificial sequence
  Synthetic peptide
DYVWEQPYALPL

SEQ ID NO: 218 - protein, 12 aa, Artificial sequence
  Synthetic peptide
AHTWWQPYALPL

SEQ ID NO: 219 - protein, 12 aa, Artificial sequence
  Synthetic peptide
FIEWFQPYALPL

SEQ ID NO: 220 - protein, 12 aa, Artificial sequence
  Synthetic peptide
WLAWEQPYALPL

SEQ ID NO: 221 - protein, 12 aa, Artificial sequence
  Synthetic peptide
VMEWWQPYALPL

SEQ ID NO: 222 - protein, 11 aa, Artificial sequence
  Synthetic peptide
ERMWQPYALPL

SEQ ID NO: 223 - protein, 12 aa, Artificial sequence
  Synthetic peptide
  Misc feature (2)..(3): Xaa can be any naturally occurring amino acid
  Misc feature (5)..(6): Xaa can be any naturally occurring amino acid
NXXWXXPYALPL

SEQ ID NO: 224 - protein, 12 aa, Artificial sequence
  Synthetic peptide
WGNWYQPYALPL

SEQ ID NO: 225 - protein, 12 aa, Artificial sequence
  Synthetic peptide
TLYWEQPYALPL

SEQ ID NO: 226 - protein, 12 aa, Artificial sequence
  Synthetic peptide
VWRWEQPYALPL

SEQ ID NO: 227 - protein, 11 aa, Artificial sequence
  Synthetic peptide
LLWTQPYALPL

SEQ ID NO: 228 - protein, 12 aa, Artificial sequence
  Synthetic peptide
  Misc feature (5)..(6): Xaa can be any naturally occurring amino acid
SRIWXXPYALPL

SEQ ID NO: 229 - protein, 12 aa, Artificial sequence
  Synthetic peptide
SDIWYQPYALPL

SEQ ID NO: 230 - protein, 12 aa, Artificial sequence
  Synthetic peptide
  Misc feature (5)..(6): Xaa can be any naturally occurring amino acid
WGYYXXPYALPL

SEQ ID NO: 231 - protein, 12 aa, Artificial sequence
  Synthetic peptide
TSGWYQPYALPL

SEQ ID NO: 232 - protein, 12 aa, Artificial sequence
  Synthetic peptide
  Misc feature (5)..(6): Xaa can be any naturally occurring amino acid
VHPYXXPYALPL

SEQ ID NO: 233 - protein, 12 aa, Artificial sequence
  Synthetic peptide
EHSYFQPYALPL

SEQ ID NO: 234 - protein, 12 aa, Artificial sequence
  Synthetic peptide
  Misc feature (1)..(2): Xaa can be any naturally occurring amino acid
XXIWYQPYALPL

SEQ ID NO: 235 - protein, 12 aa, Artificial sequence
  Synthetic peptide
AQLHSQPYALPL

SEQ ID NO: 236 - protein, 12 aa, Artificial sequence
  Synthetic peptide
WANWFQPYALPL

SEQ ID NO: 237 - protein, 12 aa, Artificial sequence
  Synthetic peptide
SRLYSQPYALPL

SEQ ID NO: 238 - protein, 12 aa, Artificial sequence
  Synthetic peptide
GVTFSQPYALPL

SEQ ID NO: 239 - protein, 12 aa, Artificial sequence
  Synthetic peptide
SIVWSQPYALPL

SEQ ID NO: 240 - protein, 12 aa, Artificial sequence
  Synthetic peptide
SRDLVQPYALPL

SEQ ID NO: 241 - protein, 17 aa, Artificial sequence
  Synthetic peptide
HWGHVYWQPYSVQDDLG

SEQ ID NO: 242 - protein, 17 aa, Artificial sequence
  Synthetic peptide
SWHSVYWQPYSVQSVPE

SEQ ID NO: 243 - protein, 17 aa, Artificial sequence
  Synthetic peptide
WRDSVYWQPYSVQPESA

SEQ ID NO: 244 - protein, 17 aa, Artificial sequence
  Synthetic peptide
TWDAVYWQPYSVQKWLD

SEQ ID NO: 245 - protein, 17 aa, Artificial sequence
  Synthetic peptide
TPPWVYWQPYSVQSLDP

SEQ ID NO: 246 - protein, 17 aa, Artificial sequence
  Synthetic peptide
YWSSVYWQPYSVQSVHS

SEQ ID NO: 247 - protein, 10 aa, Artificial sequence
  Synthetic peptide
YWYQPYALGL

SEQ ID NO: 248 - protein, 10 aa, Artificial sequence
  Synthetic peptide
YWYQPYALPL

SEQ ID NO: 249 - protein, 10 aa, Artificial sequence
  Synthetic peptide
EWIQPYATGL

SEQ ID NO: 250 - protein, 10 aa, Artificial sequence
  Synthetic peptide
NWEQPYAKPL

SEQ ID NO: 251 - protein, 10 aa, Artificial sequence
  Synthetic peptide
AFYQPYALPL

SEQ ID NO: 252 - protein, 10 aa, Artificial sequence
  Synthetic peptide
FLYQPYALPL

SEQ ID NO: 253 - protein, 10 aa, Artificial sequence
  Synthetic peptide
VCKQPYLEWC

SEQ ID NO: 254 - protein, 21 aa, Artificial sequence
  Synthetic peptide
ETPFTWEESNAYYWQPYALPL

SEQ ID NO: 255 - protein, 21 aa, Artificial sequence
  Synthetic peptide
QGWLTWQDSVDMYWQPYALPL

SEQ ID NO: 256 - protein, 21 aa, Artificial sequence
  Synthetic peptide
FSEAGYTWPENTYWQPYALPL

SEQ ID NO: 257 - protein, 21 aa, Artificial sequence
  Synthetic peptide
TESPGGLDWAKIYWQPYALPL

SEQ ID NO: 258 - protein, 21 aa, Artificial sequence
  Synthetic peptide
DGYDRWRQSGERYWQPYALPL

SEQ ID NO: 259 - protein, 21 aa, Artificial sequence
  Synthetic peptide
TANVSSFEWTPGYWQPYALPL

SEQ ID NO: 260 - protein, 21 aa, Artificial sequence
  Synthetic peptide
SVGEDHNFWTSEYWQPYALPL

SEQ ID NO: 261 - protein, 21 aa, Artificial sequence
  Synthetic peptide
MNDQTSEVSTFPYWQPYALPL

SEQ ID NO: 262 - protein, 21 aa, Artificial sequence
  Synthetic peptide
SWSEAFEQPRNLYWQPYALPL

SEQ ID NO: 263 - protein, 21 aa, Artificial sequence
  Synthetic peptide
QYAEPSALNDWGYWQPYALPL

SEQ ID NO: 264 - protein, 21 aa, Artificial sequence
  Synthetic peptide
NGDWATADWSNYYWQPYALPL

SEQ ID NO: 265 - protein, 15 aa, Artificial sequence
  Synthetic peptide
THDEHIYWQPYALPL

SEQ ID NO: 266 - protein, 21 aa, Artificial sequence
  Synthetic peptide
MLEKTYTTWTPGYWQPYALPL

SEQ ID NO: 267 - protein, 20 aa, Artificial sequence
  Synthetic peptide
WSDPLTRDADLYWQPYALPL

SEQ ID NO: 268 - protein, 21 aa, Artificial sequence
  Synthetic peptide
SDAFTTQDSQAMYWQPYALPL

SEQ ID NO: 269 - protein, 21 aa, Artificial sequence
  Synthetic peptide
GDDAAWRTDSLTYWQPYALPL

SEQ ID NO: 270 - protein, 21 aa, Artificial sequence
  Synthetic peptide
AIIRQLYRWSEMYWQPYALPL

SEQ ID NO: 271 - protein, 21 aa, Artificial sequence
  Synthetic peptide
ENTYSPNWADSMYWQPYALPL

SEQ ID NO: 272 - protein, 21 aa, Artificial sequence
  Synthetic peptide
MNDQTSEVSTFPYWQPYALPL

SEQ ID NO: 273 - protein, 21 aa, Artificial sequence
  Synthetic peptide
SVGEDHNFWTSEYWQPYALPL

SEQ ID NO: 274 - protein, 21 aa, Artificial sequence
  Synthetic peptide
QTPFTWEESNAYYWQPYALPL

SEQ ID NO: 275 - protein, 21 aa, Artificial sequence
  Synthetic peptide
ENPFTWQESNAYYWQPYALPL

SEQ ID NO: 276 - protein, 21 aa, Artificial sequence
  Synthetic peptide
VTPFTWEDSNVFYWQPYALPL

SEQ ID NO: 277 - protein, 21 aa, Artificial sequence
  Synthetic peptide
QIPFTWEQSNAYYWQPYALPL

SEQ ID NO: 278 - protein, 21 aa, Artificial sequence
  Synthetic peptide
QAPLTWQESAAYYWQPYALPL

SEQ ID NO: 279 - protein, 21 aa, Artificial sequence
  Synthetic peptide
EPTFTWEESKATYWQPYALPL

SEQ ID NO: 280 - protein, 21 aa, Artificial sequence
  Synthetic peptide
TTTLTWEESNAYYWQPYALPL

SEQ ID NO: 281 - protein, 21 aa, Artificial sequence
  Synthetic peptide
ESPLTWEESSALYWQPYALPL

SEQ ID NO: 282 - protein, 21 aa, Artificial sequence
  Synthetic peptide
ETPLTWEESNAYYWQPYALPL

SEQ ID NO: 283 - protein, 21 aa, Artificial sequence
  Synthetic peptide
EATFTWAESNAYYWQPYALPL

SEQ ID NO: 284 - protein, 21 aa, Artificial sequence
  Synthetic peptide
EALFTWKESTAYYWQPYALPL

SEQ ID NO: 285 - protein, 20 aa, Artificial sequence
  Synthetic peptide
STPTWEESNAYYWQPYALPL

SEQ ID NO: 286 - protein, 21 aa, Artificial sequence
  Synthetic peptide
ETPFTWEESNAYYWQPYALPL

SEQ ID NO: 287 - protein, 21 aa, Artificial sequence
  Synthetic peptide
KAPFTWEESQAYYWQPYALPL

SEQ ID NO: 288 - protein, 21 aa, Artificial sequence
  Synthetic peptide
STSFTWEESNAYYWQPYALPL

SEQ ID NO: 289 - protein, 21 aa, Artificial sequence
  Synthetic peptide
DSTFTWEESNAYYWQPYALPL

SEQ ID NO: 290 - protein, 21 aa, Artificial sequence
  Synthetic peptide
YIPFTWEESNAYYWQPYALPL

SEQ ID NO: 291 - protein, 21 aa, Artificial sequence
  Synthetic peptide
QTAFTWEESNAYYWQPYALPL

SEQ ID NO: 292 - protein, 21 aa, Artificial sequence
  Synthetic peptide
ETLFTWEESNATYWQPYALPL

SEQ ID NO: 293 - protein, 21 aa, Artificial sequence
  Synthetic peptide
VSSFTWEESNAYYWQPYALPL

SEQ ID NO: 294 - protein, 7 aa, Artificial sequence
  Synthetic peptide
QPYALPL

SEQ ID NO: 295 - protein, 10 aa, Artificial sequence
  Synthetic peptide
  Misc feature (1)..(1): Xaa=Unsure
  Misc feature (2)..(2): Ala modified to 1-naphthylalanine at position 2
  Misc feature (5)..(6): Azetidine is between residues 5 and 6
XAPYQYALPL

SEQ ID NO: 296 - protein, 21 aa, Artificial sequence
  Synthetic peptide
TANVSSFEWTPGYWQPYALPL

SEQ ID NO: 297 - protein, 15 aa, Artificial sequence
  Synthetic peptide
FEWTPGYWQPYALPL

SEQ ID NO: 298 - protein, 14 aa, Artificial sequence
  Synthetic peptide
  Misc feature (9)..(10): Azetidine is between residues 9 and 10
FEWTPGYWQYALPL

SEQ ID NO: 299 - protein, 14 aa, Artificial sequence
  Synthetic peptide
  Misc feature (9)..(10): Azetidine is between residues 9 and 10
FEWTPGYYQYALPL

SEQ ID NO: 300 - protein, 21 aa, Artificial sequence
  Synthetic peptide
ETPFTWEESNAYYWQPYALPL

SEQ ID NO: 301 - protein, 17 aa, Artificial sequence
  Synthetic peptide
  Misc feature (12)..(13): Azetidine is between residues 12 and 13
FTWEESNAYYWQYALPL

SEQ ID NO: 302 - protein, 16 aa, Artificial sequence
  Synthetic peptide
ADVLYWQPYAPVTLWV

SEQ ID NO: 303 - protein, 17 aa, Artificial sequence
  Synthetic peptide
GDVAEYWQPYALPLTSL

SEQ ID NO: 304 - protein, 18 aa, Artificial sequence
  Synthetic peptide
SWTDYGYWQPYALPISGL

SEQ ID NO: 305 - protein, 15 aa, Artificial sequence
  Synthetic peptide
FEWTPGYWQPYALPL

SEQ ID NO: 306 - protein, 14 aa, Artificial sequence
  Synthetic peptide
  Misc feature (9)..(10): Azetidine is between residues 9 and 10
FEWTPGYWQYALPL

SEQ ID NO: 307 - protein, 15 aa, Artificial sequence
  Synthetic peptide
FEWTPGWYQPYALPL

SEQ ID NO: 308 - protein, 14 aa, Artificial sequence
  Synthetic peptide
  Misc feature (9)..(10): Azetidine is between residues 9 and 10
FEWTPGWYQYALPL

SEQ ID NO: 309 - protein, 15 aa, Artificial sequence
  Synthetic peptide
FEWTPGYYQPYALPL

SEQ ID NO: 310 - protein, 14 aa, Artificial sequence
  Synthetic peptide
  Misc feature (9)..(10): Azetidine is between residues 9 and 10
FEWTPGYYQYALPL

SEQ ID NO: 311 - protein, 21 aa, Artificial sequence
  Synthetic peptide
TANVSSFEWTPGYWQPYALPL

SEQ ID NO: 312 - protein, 18 aa, Artificial sequence
  Synthetic peptide
SWTDYGYWQPYALPISGL

SEQ ID NO: 313 - protein, 21 aa, Artificial sequence
  Synthetic peptide
ETPFTWEESNAYYWQPYALPL

SEQ ID NO: 314 - protein, 21 aa, Artificial sequence
  Synthetic peptide
ENTYSPNWADSMYWQPYALPL

SEQ ID NO: 315 - protein, 21 aa, Artificial sequence
  Synthetic peptide
SVGEDHNFWTSEYWQPYALPL

SEQ ID NO: 316 - protein, 21 aa, Artificial sequence
  Synthetic peptide
DGYDRWRQSGERYWQPYALPL

SEQ ID NO: 317 - protein, 15 aa, Artificial sequence
  Synthetic peptide
FEWTPGYWQPYALPL

SEQ ID NO: 318 - protein, 11 aa, Artificial sequence
  Synthetic peptide
FEWTPGYWQPY

SEQ ID NO: 319 - protein, 10 aa, Artificial sequence
  Synthetic peptide
  Misc feature (9)..(10): Azetidine is between residues 9 and 10
FEWTPGYWQY

SEQ ID NO: 320 - protein, 10 aa, Artificial sequence
  Synthetic peptide
EWTPGYWQPY

SEQ ID NO: 321 - protein, 10 aa, Artificial sequence
  Synthetic peptide
  Misc feature (9)..(10): Azetidine is between residues 9 and 10
FEWTPGWYQY

SEQ ID NO: 322 - protein, 10 aa, Artificial sequence
  Synthetic peptide
  Misc feature (9)..(10): Azetidine is between residues 9 and 10
AEWTPGYWQY

SEQ ID NO: 323 - protein, 10 aa, Artificial sequence
  Synthetic peptide
  Misc feature (9)..(10): Azetidine is between residues 9 and 10
FAWTPGYWQY

SEQ ID NO: 324 - protein, 10 aa, Artificial sequence
  Synthetic peptide
  Misc feature (9)..(10): Azetidine is between residues 9 and 10
FEATPGYWQY

SEQ ID NO: 325 - protein, 10 aa, Artificial sequence
  Synthetic peptide
  Misc feature (9)..(10): Azetidine is between residues 9 and 10
FEWAPGYWQY

SEQ ID NO: 326 - protein, 10 aa, Artificial sequence
  Synthetic peptide
  Misc feature (9)..(10): Azetidine is between residues 9 and 10
FEWTAGYWQY

SEQ ID NO: 327 - protein, 10 aa, Artificial sequence
  Synthetic peptide
  Misc feature (9)..(10): Azetidine is between residues 9 and 10
FEWTPAYWQY

SEQ ID NO: 328 - protein, 10 aa, Artificial sequence
  Synthetic peptide
  Misc feature (9)..(10): Azetidine is between residues 9 and 10
FEWTPGAWQY

SEQ ID NO: 329 - protein, 10 aa, Artificial sequence
  Synthetic peptide
  Misc feature (9)..(10): Azetidine is between residues 9 and 10
FEWTPGYAQY

SEQ ID NO: 330 - protein, 10 aa, Artificial sequence
  Synthetic peptide
  Misc feature (9)..(10): Azetidine is between residues 9 and 10
FEWTPGYWQA

SEQ ID NO: 331 - protein, 10 aa, Artificial sequence
  Synthetic peptide
  Misc feature (9)..(10): Azetidine is between residues 9 and 10
FEWTGGYWQY

SEQ ID NO: 332 - protein, 10 aa, Artificial sequence
  Synthetic peptide
  Misc feature (5)..(5): D-Pro
  Misc feature (9)..(10): Azetidine is between residues 9 and 10
FEWTPGYWQY

SEQ ID NO: 333 - protein, 9 aa, Artificial sequence
  Synthetic peptide
  Misc feature (4)..(5): Azetidine is between residues 4 and 5
  Misc feature (8)..(9): Azetidine is between residues 8 and 9
FEWTGYWQY

SEQ ID NO: 334 - protein, 9 aa, Artificial sequence
  Synthetic peptide
  Misc feature (4)..(5): Pipecolic acid is between residues 4 and 5
  Misc feature (8)..(9): Azetidine is between residues 8 and 9
FEWTGYWQY

SEQ ID NO: 335 - protein, 9 aa, Artificial sequence
  Synthetic peptide
  Misc feature (5)..(6): Aminoisobutyric acid is between residues 5 and 6
  Misc feature (8)..(9): Azetidine is between residues 8 and 9
FEWTPYWQY

SEQ ID NO: 336 - protein, 10 aa, Artificial sequence
  Synthetic peptide
  Misc feature (6)..(6): Xaa=Sarcosine
  Misc feature (9)..(10): Azetidine is between residues 9 and 10
FEWTPXWYQY

SEQ ID NO: 337 - protein, 10 aa, Artificial sequence
  Synthetic peptide
  Misc feature (5)..(5): Xaa=Sarcosine
  Misc feature (9)..(10): Azetidine is between residues 9 and 10
FEWTXGYWQY

SEQ ID NO: 338 - protein, 10 aa, Artificial sequence
  Synthetic peptide
  Misc feature (9)..(10): Azetidine is between residues 9 and 10
FEWTPNYWQY

SEQ ID NO: 339 - protein, 10 aa, Artificial sequence
  Synthetic peptide
  Misc feature (9)..(10): Azetidine is between residues 9 and 10
FEWTPVYWQY

SEQ ID NO: 340 - protein, 10 aa, Artificial sequence
  Synthetic peptide
  Misc feature (9)..(10): Azetidine is between residues 9 and 10
FEWTVPYWQY

SEQ ID NO: 341 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGWYQY

SEQ ID NO: 342 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGYWQY

SEQ ID NO: 343 - protein, 10 aa, Artificial sequence
  Synthetic peptide
  Misc feature (1)..(1): Ala modified to 1-naphthylalanine at position 1
  Misc feature (9)..(10): Azetidine is between residues 9 and 10
AEWTPGYYQY

SEQ ID NO: 344 - protein, 10 aa, Artificial sequence
  Synthetic peptide
  Misc feature (9)..(10): Azetidine is between residues 9 and 10
YEWTPGYYQY

SEQ ID NO: 345 - protein, 10 aa, Artificial sequence
  Synthetic peptide
  Misc feature (9)..(10): Azetidine is between residues 9 and 10
FEWVPGYYQY

SEQ ID NO: 346 - protein, 10 aa, Artificial sequence
  Synthetic peptide
  Misc feature (9)..(10): Azetidine is between residues 9 and 10
FEWTPGYYQY

SEQ ID NO: 347 - protein, 10 aa, Artificial sequence
  Synthetic peptide
  Misc feature (9)..(10): Azetidine is between residues 9 and 10
FEWTPSYYQY

SEQ ID NO: 348 - protein, 10 aa, Artificial sequence
  Synthetic peptide
  Misc feature (9)..(10): Azetidine is between residues 9 and 10
FEWTPNYYQY

SEQ ID NO: 349 - protein, 12 aa, Artificial sequence
  Synthetic peptide
  Misc feature (5)..(5): Ala modified to 1-naphthylalanine at position 5
SHLYAQPYSVQM

SEQ ID NO: 350 - protein, 12 aa, Artificial sequence
  Synthetic peptide
  Misc feature (5)..(5): Ala modified to 1-naphthylalanine at position 5
TLVYAQPYSLQT

SEQ ID NO: 351 - protein, 12 aa, Artificial sequence
  Synthetic peptide
  Misc feature (5)..(5): Ala modified to 1-naphthylalanine at position 5
RGDYAQPYSVQS

SEQ ID NO: 352 - protein, 12 aa, Artificial sequence
  Synthetic peptide
  Misc feature (5)..(5): Ala modified to 1-naphthylalanine at position 5
NMVYAQPYSIQT

SEQ ID NO: 353 - protein, 9 aa, Artificial sequence
  Synthetic peptide
VYWQPYSVQ

SEQ ID NO: 354 - protein, 9 aa, Artificial sequence
  Synthetic peptide
  Misc feature (3)..(3): Ala modified to 1-naphthylalanine at position 5
VYAQPYSVQ

SEQ ID NO: 355 - protein, 11 aa, Artificial sequence
  Synthetic peptide
  Misc feature (6)..(7): Azetidine is between residues 6 and 7
TFVYWQYALPL

SEQ ID NO: 356 - protein, 10 aa, Artificial sequence
  Synthetic peptide
  Misc feature (9)..(10): Azetidine is between residues 9 and 10
  Misc feature (10)..(10): Phe modified to p-benzoyl-L-phenylalanine at position 10
FEWTPGYYQF

SEQ ID NO: 357 - protein, 10 aa, Artificial sequence
  Synthetic peptide
  Misc feature (9)..(10): Azetidine is between residues 9 and 10
  Misc feature (10)..(10): Phe modified to p-benzoyl-L-phenylalanine at position 10
FEWTPGYYQF

SEQ ID NO: 358 - protein, 10 aa, Artificial sequence
  Synthetic peptide
  Misc feature (8)..(8): Xaa=p-benzoyl-L-phenylalanine
  Misc feature (9)..(10): Azetidine is between residues 9 and 10
FEWTPGYXQY

SEQ ID NO: 359 - protein, 10 aa, Artificial sequence
  Synthetic peptide
  Acetylation (1)..(1): Acetylated phenylalanine at position 1
  Misc feature (8)..(8): Phe modified to p-benzoyl-L-phenylalanine at position 8
  Misc feature (9)..(10): Azetidine is between positions 9 and 10
FEWTPGYFQY

SEQ ID NO: 360 - protein, 10 aa, Artificial sequence
  Synthetic peptide
  Misc feature (7)..(7): Phe modified to p-benzoyl-L-phenylalanine at position 7
  Misc feature (9)..(10): Azetidine is between residues 9 and 10
FEWTPGFYQY

SEQ ID NO: 361 - protein, 10 aa, Artificial sequence
  Synthetic peptide
  Acetylation (1)..(1): Acetylated phenylalanine at position 1
  Misc feature (7)..(7): Phe modified to p-benzoyl-L-phenylalanine at position 7
  Misc feature (9)..(10): Azetidine is between residues 9 and 10
FEWTPGFYQY

SEQ ID NO: 362 - protein, 10 aa, Artificial sequence
  Synthetic peptide
  Acetylation (1)..(1): Acetylated phenylalanine at position 1
  Misc feature (3)..(3): Phe modified to p-benzoyl-L-phenylalanine at position 3
  Misc feature (9)..(10): Azetidine is between residues 9 and 10
FEFTPGYYQY

SEQ ID NO: 363 - protein, 10 aa, Artificial sequence
  Synthetic peptide
  Acetylation (1)..(1): Acetylated phenylalanine at position 1
  Misc feature (3)..(3): Phe modified to p-benzoyl-L-phenylalanine at position 3
  Misc feature (9)..(10): Azetidine is between residues 9 and 10
FEFTPGYYQY

SEQ ID NO: 364 - protein, 10 aa, Artificial sequence
  Synthetic peptide
  Misc feature (1)..(1): Phe modified to p-benzoyl-L-phenylalanine at position 1
  Misc feature (9)..(10): Azetidine is between residues 9 and 10
FEWTPGYYQY

SEQ ID NO: 365 - protein, 10 aa, Artificial sequence
  Synthetic peptide
  Misc feature (1)..(1): Phe modified to acetylated p-benzoyl-L-phenylalanine at position 1
  Misc feature (9)..(10): Azetidine is between residues 9 and 10
FEWTPGYYQY

SEQ ID NO: 366 - protein, 9 aa, Artificial sequence
  Synthetic peptide
VYWQPYSVQ

SEQ ID NO: 367 - protein, 12 aa, Artificial sequence
  Synthetic peptide
RLVYWQPYSVQR

SEQ ID NO: 368 - protein, 12 aa, Artificial sequence
  Synthetic peptide
  Misc feature (5)..(5): Ala modified to 1-naphthylalanine at position 5
RLVYAQPYSVQR

SEQ ID NO: 369 - protein, 12 aa, Artificial sequence
  Synthetic peptide
RLDYWQPYSVQR

SEQ ID NO: 370 - protein, 12 aa, Artificial sequence
  Synthetic peptide
RLVWFQPYSVQR

SEQ ID NO: 371 - protein, 12 aa, Artificial sequence
  Synthetic peptide
RLVYWQPYSIQR

SEQ ID NO: 372 - protein, 11 aa, Artificial sequence
  Synthetic peptide
DNSSWYDSFLL

SEQ ID NO: 373 - protein, 11 aa, Artificial sequence
  Synthetic peptide
DNTAWYESFLA

SEQ ID NO: 374 - protein, 11 aa, Artificial sequence
  Synthetic peptide
DNTAWYENFLL

SEQ ID NO: 375 - protein, 17 aa, Artificial sequence
  Synthetic peptide
PAREDNTAWYDSFLIWC

SEQ ID NO: 376 - protein, 17 aa, Artificial sequence
  Synthetic peptide
TSEYDNTTWYEKFLASQ

SEQ ID NO: 377 - protein, 17 aa, Artificial sequence
  Synthetic peptide
SQIPDNTAWYQSFLLHG

SEQ ID NO: 378 - protein, 17 aa, Artificial sequence
  Synthetic peptide
SPFIDNTAWYENFLLTY

SEQ ID NO: 379 - protein, 17 aa, Artificial sequence
  Synthetic peptide
EQIYDNTAWYDHFLLSY

SEQ ID NO: 380 - protein, 17 aa, Artificial sequence
  Synthetic peptide
TPFIDNTAWYENFLLTY

SEQ ID NO: 381 - protein, 17 aa, Artificial sequence
  Synthetic peptide
TYTYDNTAWYERFLMSY

SEQ ID NO: 382 - protein, 17 aa, Artificial sequence
  Synthetic peptide
TMTQDNTAWYENFLLSY

SEQ ID NO: 383 - protein, 17 aa, Artificial sequence
  Synthetic peptide
TIDNTAWYANLVQTYPQ

SEQ ID NO: 384 - protein, 17 aa, Artificial sequence
  Synthetic peptide
TIDNTAWYERFLAQYPD

SEQ ID NO: 385 - protein, 17 aa, Artificial sequence
  Synthetic peptide
HIDNTAWYENFLLTYTP

SEQ ID NO: 386 - protein, 17 aa, Artificial sequence
  Synthetic peptide
SQDNTAWYENFLLSYKA

SEQ ID NO: 387 - protein, 17 aa, Artificial sequence
  Synthetic peptide
QIDNTAWYERFLLQYNA

SEQ ID NO: 388 - protein, 17 aa, Artificial sequence
  Synthetic peptide
NQDNTAWYESFLLQYNT

SEQ ID NO: 389 - protein, 17 aa, Artificial sequence
  Synthetic peptide
TIDNTAWYENFLLNHNL

SEQ ID NO: 390 - protein, 17 aa, Artificial sequence
  Synthetic peptide
HYDNTAWYERFLQQGWH

SEQ ID NO: 391 - protein, 21 aa, Artificial sequence
  Synthetic peptide
ETPFTWEESNAYYWQPYALPL

SEQ ID NO: 392 - protein, 21 aa, Artificial sequence
  Synthetic peptide
YIPFTWEESNAYYWQPYALPL

SEQ ID NO: 393 - protein, 21 aa, Artificial sequence
  Synthetic peptide
DGYDRWRQSGERYWQPYALPL

SEQ ID NO: 394 - protein, 9 aa, Artificial sequence
  Synthetic peptide
  Phosphorylation (1)..(1): Phosphotyrosine at position 1
  Misc feature (2)..(2): Ala modified to 1-naphthylalanine at position 2
  Phosphorylation (3)..(3): Phosphotyrosine at position 3
  Misc feature (4)..(5): Azetidine is between residues 4 and 5
YAYQYALPL

SEQ ID NO: 395 - protein, 21 aa, Artificial sequence
  Synthetic peptide
TANVSSFEWTPGYWQPYALPL

SEQ ID NO: 396 - protein, 14 aa, Artificial sequence
  Synthetic peptide
  Misc feature (9)..(10): Azetidine is between residues 9 and 10
FEWTPGYWQYALPL

SEQ ID NO: 397 - protein, 17 aa, Artificial sequence
  Synthetic peptide
FEWTPGYWQPYALPLSD

SEQ ID NO: 398 - protein, 14 aa, Artificial sequence
  Synthetic peptide
  Misc feature (9)..(10): Azetidine is between residues 9 and 10
FEWTPGYYQYALPL

SEQ ID NO: 399 - protein, 10 aa, Artificial sequence
  Synthetic peptide
  Misc feature (9)..(10): Azetidine is between residues 9 and 10
FEWTPGYWQY

SEQ ID NO: 400 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGYWQY

SEQ ID NO: 401 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGWYQY

SEQ ID NO: 402 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGYYQY

SEQ ID NO: 403 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPAYWQY

SEQ ID NO: 404 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPAWYQY

SEQ ID NO: 405 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPAYYQY

SEQ ID NO: 406 - protein, 14 aa, Artificial sequence
  Synthetic peptide
  Misc feature (9)..(10): Azetidine is between residues 9 and 10
FEWTPGYYQYALPL

SEQ ID NO: 407 - protein, 14 aa, Artificial sequence
  Synthetic peptide
  Misc feature (9)..(10): Azetidine is between residues 9 and 10
FEWTPGYWQYALPL

SEQ ID NO: 408 - protein, 14 aa, Artificial sequence
  Synthetic peptide
  Misc feature (9)..(10): Azetidine is between residues 9 and 10
FEWTPGWYQYALPL

SEQ ID NO: 409 - protein, 21 aa, Artificial sequence
  Synthetic peptide
TANVSSFEWTPGYWQPYALPL

SEQ ID NO: 410 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGYWQY

SEQ ID NO: 411 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGWYQY

SEQ ID NO: 412 - protein, 10 aa, Artificial sequence
  Synthetic peptide
  Acetylation (1)..(1): Acetylated phenylalanine at position 1
  Misc feature (9)..(10): Azetidine is between residues 9 and 10
FEWTPGYYQY

SEQ ID NO: 413 - protein, 10 aa, Artificial sequence
  Synthetic peptide
  Acetylation (1)..(1): Acetylated phenylalanine at position 1
  Misc feature (6)..(6): D-Ala
  Misc feature (9)..(10): Azetidine is between residues 9 and 10
FEWTPAYWQY

SEQ ID NO: 414 - protein, 10 aa, Artificial sequence
  Synthetic peptide
  Acetylation (1)..(1): Acetylated phenylalanine at position 1
  Misc feature (6)..(6): D-Ala
  Misc feature (9)..(10): Azetidine is between residues 9 and 10
FEWTPAWYQY

SEQ ID NO: 415 - protein, 10 aa, Artificial sequence
  Synthetic peptide
  Acetylation (1)..(1): Acetylated phenylalanine at position 1
  Misc feature (6)..(6): D-Ala
  Misc feature (9)..(10): Azetidine is between residues 9 and 10
FEWTPAYYQY

SEQ ID NO: 416 - protein, 14 aa, Artificial sequence
  Synthetic peptide
  Misc feature (2)..(2): Xaa can be any naturally occurring amino acid
  Misc feature (4)..(5): Xaa can be any naturally occurring amino acid
  Misc feature (8)..(8): Xaa can be any naturally occurring amino acid
  Misc feature (11)..(11): Xaa can be any naturally occurring amino acid
  Misc feature (13)..(13): Xaa can be any naturally occurring amino acid
YXCXXGPXTWXCXP

SEQ ID NO: 417 - protein, 14 aa, Artificial sequence
  Synthetic peptide
  Misc feature (2)..(2): Xaa can be any naturally occurring amino acid
  Misc feature (4)..(5): Xaa can be any naturally occurring amino acid
  Misc feature (8)..(8): Xaa can be any naturally occurring amino acid
  Misc feature (11)..(11): Xaa can be any naturally occurring amino acid
  Misc feature (13)..(13): Xaa can be any naturally occurring amino acid
YXCXXGPXTWXCXP

SEQ ID NO: 418 - protein, 14 aa, Artificial sequence
  Synthetic peptide
  Misc feature (2)..(2): Xaa can be any naturally occurring amino acid
  Misc feature (4)..(5): Xaa can be any naturally occurring amino acid
  Misc feature (8)..(8): Xaa can be any naturally occurring amino acid
  Misc feature (11)..(11): Xaa can be any naturally occurring amino acid
  Misc feature (13)..(13): Xaa can be any naturally occurring amino acid
YXCXXGPXTWXCXP

SEQ ID NO: 419 - protein, 14 aa, Artificial sequence
  Synthetic peptide
  Misc feature (2)..(2): Xaa can be any naturally occurring amino acid
  Misc feature (4)..(5): Xaa can be any naturally occurring amino acid
  Misc feature (8)..(8): Xaa can be any naturally occurring amino acid
  Misc feature (11)..(11): Xaa can be any naturally occurring amino acid
  Misc feature (13)..(13): Xaa can be any naturally occurring amino acid
YXCXXGPXTWXCXP

SEQ ID NO: 420 - protein, 20 aa, Artificial sequence
  Synthetic peptide
GGTYSCHFGPLTWVCKPQGG

SEQ ID NO: 421 - protein, 20 aa, Artificial sequence
  Synthetic peptide
GGDYHCRMGPLTWVCKPLGG

SEQ ID NO: 422 - protein, 20 aa, Artificial sequence
  Synthetic peptide
GGVYACRMGPITWVCSPLGG

SEQ ID NO: 423 - protein, 20 aa, Artificial sequence
  Synthetic peptide
VGNYMCHFGPITWVCRPGGG

SEQ ID NO: 424 - protein, 20 aa, Artificial sequence
  Synthetic peptide
GGLYLCRFGPVTWDCGYKGG

SEQ ID NO: 425 - protein, 40 aa, Artificial sequence
  Synthetic peptide
GGTYSCHFGPLTWVCKPQGGGGTYSCHFGPLTWVCKPQGG

SEQ ID NO: 426 - protein, 20 aa, Artificial sequence
  Synthetic peptide
GGTYSCHFGPLTWVCKPQGG

SEQ ID NO: 427 - protein, 23 aa, Artificial sequence
  Synthetic peptide
GGTYSCHFGPLTWVCKPQGGSSK

SEQ ID NO: 428 - protein, 23 aa, Artificial sequence
  Synthetic peptide
GGTYSCHFGPLTWVCKPQGGSSK

SEQ ID NO: 429 - protein, 23 aa, Artificial sequence
  Synthetic peptide
GGTYSCHFGPLTWVCKPQGGSSK

SEQ ID NO: 430 - protein, 22 aa, Artificial sequence
  Synthetic peptide
GGTYSCHFGPLTWVCKPQGGSS

SEQ ID NO: 431 - protein, 23 aa, Artificial sequence
  Synthetic peptide
GGTYSCHFGPLTWVCKPQGGSSK

SEQ ID NO: 432 - protein, 10 aa, Artificial sequence
  Synthetic peptide
  Misc feature (2)..(2): Xaa=Arg, His, Leu or Trp
  Misc feature (3)..(3): Xaa=Met, Phe or Ile
  Misc feature (6)..(6): Xaa=any amino acid
  Misc feature (7)..(7): Xaa=Asp, Glu, Ile, Leu or Val
  Misc feature (9)..(9): Xaa=any amino acid
CXXGPXTWXC

SEQ ID NO: 433 - protein, 19 aa, Artificial sequence
  Synthetic peptide
GGTYSCHGPLTWVCKPQGG

SEQ ID NO: 434 - protein, 19 aa, Artificial sequence
  Synthetic peptide
VGNYMAHMGPITWVCRPGG

SEQ ID NO: 435 - protein, 18 aa, Artificial sequence
  Synthetic peptide
GGPHHVYACRMGPLTWIC

SEQ ID NO: 436 - protein, 18 aa, Artificial sequence
  Synthetic peptide
GGTYSCHFGPLTWVCKPQ

SEQ ID NO: 437 - protein, 20 aa, Artificial sequence
  Synthetic peptide
GGLYACHMGPMTWVCQPLRG

SEQ ID NO: 438 - protein, 22 aa, Artificial sequence
  Synthetic peptide
TIAQYICYMGPETWECRPSPKA

SEQ ID NO: 439 - protein, 13 aa, Artificial sequence
  Synthetic peptide
YSCHFGPLTWVCK

SEQ ID NO: 440 - protein, 11 aa, Artificial sequence
  Synthetic peptide
YCHFGPLTWVC

SEQ ID NO: 441 - protein, 10 aa, Artificial sequence
  Synthetic peptide
  Misc feature (1)..(1): Xaa=Cys, Ala, or nothing
  Misc feature (1)..(2): If residue 1 is not Cys or Ala, alpha-amino-gamma-bromobutyric acid or homocysteine (HOC) is before residue 2
  Misc feature (2)..(2): Xaa=Arg, His, Leu, or Trp
  Misc feature (3)..(3): Xaa=Met, Phe, or Ile
  Misc feature (6)..(6): Xaa=any amino acid
  Misc feature (9)..(9): Xaa=Asp, Glu, Ile, Leu, or Val
  Misc feature (9)..(9): If residue 10 is not Cys or Ala, alpha-amino-gamma-bromobutyric acid or homocysteine (HOC) is after residue 9
  Misc feature (10)..(10): Xaa=Cys, Ala, or nothing
XXXGPXTWXX

SEQ ID NO: 442 - protein, 12 aa, Artificial sequence
  Synthetic peptide
  Misc feature (2)..(2): Xaa=any amino acid
  Misc feature (2)..(3): If residue 3 is not Cys or Ala, alpha-amino-gamma-bromobutyric acid or homocysteine (HOC) is between residues 2 and 3
  Misc feature (3)..(3): Xaa=Cys, Ala, or nothing
  Misc feature (4)..(4): Xaa=Arg, His, Leu, or Trp
  Misc feature (5)..(5): Xaa=Met, Phe, or Ile
  Misc feature (5)..(5): Xaa=Met, Phe, or Ile
  Misc feature (8)..(8): Xaa=any amino acid
  Misc feature (8)..(8): Xaa=any amino acid
  Misc feature (11)..(11): Xaa=Asp, Glu, Ile, Leu, or Val
  Misc feature (11)..(11): If residue 12 is not Cys or Ala, alpha-amino-gamma-bromobutyric acid or homocysteine (HOC) is after residue 11
  Misc feature (12)..(12): Xaa=Cys, Ala, or nothing
YXXXXGPXTWXX

SEQ ID NO: 443 - protein, 16 aa, Artificial sequence
  Synthetic peptide
  Misc feature (1)..(1): Xaa=any amino acid
  Misc feature (3)..(3): Xaa=any amino acid
  Misc feature (3)..(4): If residue 4 is not Cys or Ala, alpha-amino-gamma-bromobutyric acid or homocysteine (HOC) is between residues 3 and 4
  Misc feature (4)..(4): Xaa=Cys, Ala, or nothing
  Misc feature (5)..(5): Xaa=Arg, His, Leu, or Trp
  Misc feature (6)..(6): Xaa=Met, Phe, or Ile
  Misc feature (9)..(9): Xaa=any amino acid
  Misc feature (12)..(12): Xaa=Asp, Glu, Ile, Leu, or Val
  Misc feature (12)..(13): If residue 13 is not Cys or Ala, alpha-amino-gamma-bromobutyric acid or homocysteine (HOC) is between residues 12 and 13
  Misc feature (13)..(13): Xaa=Cys, Ala, or nothing
  Misc feature (14)..(14): Xaa=any amino acid
  Misc feature (15)..(15): Xaa=any amino acid
  Misc feature (16)..(16): Xaa=any amino acid
XYXXXXGPXTWXXXXX

SEQ ID NO: 444 - protein, 16 aa, Artificial sequence
  Synthetic peptide
  Misc feature (1)..(1): Xaa=any amino acid
  Misc feature (3)..(3): Xaa=any amino acid
  Misc feature (5)..(5): Xaa=Arg, His, Leu or Trp
  Misc feature (6)..(6): Xaa=Met, Phe or Ile
  Misc feature (9)..(9): Xaa=any amino acid
  Misc feature (12)..(12): Xaa=Asp, Glu, Ile, Leu or Val
  Misc feature (14)..(14): Xaa=any amino acid
  Misc feature (15)..(15): Xaa=any amino acid
  Misc feature (16)..(16): Xaa=any amino acid
XYXCXXGPXTWXCXXX

SEQ ID NO: 445 - protein, 20 aa, Artificial sequence
  Synthetic peptide
GGLYLCRFGPVTWDCGYKGG

SEQ ID NO: 446 - protein, 20 aa, Artificial sequence
  Synthetic peptide
GGTYSCHFGPLTWVCKPQGG

SEQ ID NO: 447 - protein, 20 aa, Artificial sequence
  Synthetic peptide
GGDYHCRMGPLTWVCKPLGG

SEQ ID NO: 448 - protein, 20 aa, Artificial sequence
  Synthetic peptide
VGNYMCHFGPITWVCRPGGG

SEQ ID NO: 449 - protein, 20 aa, Artificial sequence
  Synthetic peptide
GGVYACRMGPITWVCSPLGG

SEQ ID NO: 450 - protein, 19 aa, Artificial sequence
  Synthetic peptide
VGNYMAHMGPITWVCRPGG

SEQ ID NO: 451 - protein, 18 aa, Artificial sequence
  Synthetic peptide
GGTYSCHFGPLTWVCKPQ

SEQ ID NO: 452 - protein, 20 aa, Artificial sequence
  Synthetic peptide
GGLYACHMGPMTWVCQPLRG

SEQ ID NO: 453 - protein, 22 aa, Artificial sequence
  Synthetic peptide
TIAQYICYMGPETWECRPSPKA

SEQ ID NO: 454 - protein, 13 aa, Artificial sequence
  Synthetic peptide
YSCHFGPLTWVCK

SEQ ID NO: 455 - protein, 11 aa, Artificial sequence
  Synthetic peptide
YCHFGPLTWVC

SEQ ID NO: 456 - protein, 12 aa, Artificial sequence
  Synthetic peptide
SCHFGPLTWVCK

SEQ ID NO: 457 - protein, 12 aa, Artificial sequence
  Synthetic peptide
  Misc feature (1)..(1): Xaa=any amino acid except Tyrosine
  Misc feature (1)..(2): If residue 2 is not Cys or Ala, alpha-amino-gamma-bromobutyric acid or homocysteine (HOC)is between residues 1 and 2
  Misc feature (2)..(2): Xaa=Cys, Ala, or nothing
  Misc feature (3)..(3): Xaa=Cys, Ala, alpha-amino-gamma-bromobutyric acid or homocysteine (HOC)
  Misc feature (4)..(4): Xaa=Arg, His, Leu, or Trp
  Misc feature (5)..(5): Xaa=Met, Phe or Ile
  Misc feature (8)..(8): Xaa=any amino acid
  Misc feature (11)..(11): Xaa=Asp, Gly, Ile, Leu, or Val
  Misc feature (11)..(11): If residue 12 is not Cys or Ala, alpha-amino-gamma-bromobutyric acid or homocysteine (HOC)is after residue 11
  Misc feature (12)..(12): Xaa=Cys, Ala, or nothing
XXXXXGPXTWXX

SEQ ID NO: 458 - protein, 17 aa, Artificial sequence
  Synthetic peptide
  Misc feature (1)..(1): Xn=Glu, Gly, Asn, Ser, Asp, Gln, Leu, Tyr, Ala, or nothing
  Misc feature (2)..(2): Xn=Phe, Val, Ala, Lys, Arg, Gly, Ser, Ile, Leu, or nothing
  Misc feature (3)..(3): Xn=His, Gln, Glu, Gly, Asp, Ala, or Val
  Misc feature (4)..(4): Xn=Glu, Gly, Val, Ala, Pro, Asp, Thr, or Met
  Misc feature (6)..(6): Xaa=any amino acid
  Misc feature (7)..(7): Xaa=any amino acid
  Misc feature (11)..(12): If residue 12 is not Cys or Ala, alpha-amino-gamma-bromobutyric acid or homocysteine (HOC)is between residues 11 and 12
  Misc feature (12)..(12): Xaa=Cys, Ala, or nothing
  Misc feature (14)..(14): Xaa=Arg, His, Leu, or Trp
  Misc feature (15)..(15): Xaa=Met, Phe, or Ile
  Misc feature (17)..(17): Xaa=Leu, Ile, Pro, Phe, Met, Gln, or Gly
XXXXCXXGWVGXCXXWX

SEQ ID NO: 459 - protein, 14 aa, Artificial sequence
  Synthetic peptide
IEGPTLRQWLAARA

SEQ ID NO: 460 - protein, 14 aa, Artificial sequence
  Synthetic peptide
IEGPTLRQWLAAKA

SEQ ID NO: 461 - protein, 14 aa, Artificial sequence
  Synthetic peptide
IEGPTLREWLAARA

SEQ ID NO: 462 - protein, 14 aa, Artificial sequence
  Synthetic peptide
IEGPTLRQWLAARA

SEQ ID NO: 463 - protein, 14 aa, Artificial sequence
  Synthetic peptide
IEGPTLRQWLAAKA

SEQ ID NO: 464 - protein, 14 aa, Artificial sequence
  Synthetic peptide
IEGPTLRQCLAARA

SEQ ID NO: 465 - protein, 14 aa, Artificial sequence
  Synthetic peptide
IEGPTLRQWLAARA

SEQ ID NO: 466 - protein, 14 aa, Artificial sequence
  Synthetic peptide
IEGPTLRQWLAARA

SEQ ID NO: 467 - protein, 28 aa, Artificial sequence
  Synthetic peptide
IEGPTLRQCLAARAIEGPTLRQWLAARA

SEQ ID NO: 468 - protein, 28 aa, Artificial sequence
  Synthetic peptide
IEGPTLRQWLAARAIEGPTLRQCLAARA

SEQ ID NO: 469 - protein, 9 aa, Artificial sequence
  Synthetic peptide
  Misc feature (6)..(8): Xaa=any amino acid
VRDQIXXXL

SEQ ID NO: 470 - protein, 6 aa, Artificial sequence
  Synthetic peptide
TLREWL

SEQ ID NO: 471 - protein, 10 aa, Artificial sequence
  Synthetic peptide
GRVRDQVAGW

SEQ ID NO: 472 - protein, 10 aa, Artificial sequence
  Synthetic peptide
GRVKDQIAQL

SEQ ID NO: 473 - protein, 10 aa, Artificial sequence
  Synthetic peptide
GVRDQVSWAL

SEQ ID NO: 474 - protein, 10 aa, Artificial sequence
  Synthetic peptide
ESVREQVMKY

SEQ ID NO: 475 - protein, 10 aa, Artificial sequence
  Synthetic peptide
SVRSQISASL

SEQ ID NO: 476 - protein, 10 aa, Artificial sequence
  Synthetic peptide
GVRETVYRHM

SEQ ID NO: 477 - protein, 11 aa, Artificial sequence
  Synthetic peptide
GVREVIVMHML

SEQ ID NO: 478 - protein, 11 aa, Artificial sequence
  Synthetic peptide
GRVRDQIWAAL

SEQ ID NO: 479 - protein, 11 aa, Artificial sequence
  Synthetic peptide
AGVRDQILIWL

SEQ ID NO: 480 - protein, 11 aa, Artificial sequence
  Synthetic peptide
GRVRDQIMLSL

SEQ ID NO: 481 - protein, 11 aa, Artificial sequence
  Synthetic peptide
  Misc feature (8)..(10): Xaa=any amino acid
GRVRDQIXXXL

SEQ ID NO: 482 - protein, 10 aa, Artificial sequence
  Synthetic peptide
CTLRQWLQGC

SEQ ID NO: 483 - protein, 10 aa, Artificial sequence
  Synthetic peptide
CTLQEFLEGC

SEQ ID NO: 484 - protein, 10 aa, Artificial sequence
  Synthetic peptide
CTRTEWLHGC

SEQ ID NO: 485 - protein, 12 aa, Artificial sequence
  Synthetic peptide
CTLREWLHGGFC

SEQ ID NO: 486 - protein, 12 aa, Artificial sequence
  Synthetic peptide
CTLREWVFAGLC

SEQ ID NO: 487 - protein, 13 aa, Artificial sequence
  Synthetic peptide
CTLRQWLILLGMC

SEQ ID NO: 488 - protein, 14 aa, Artificial sequence
  Synthetic peptide
CTLAEFLASGVEQC

SEQ ID NO: 489 - protein, 14 aa, Artificial sequence
  Synthetic peptide
CSLQEFLSHGGYVC

SEQ ID NO: 490 - protein, 14 aa, Artificial sequence
  Synthetic peptide
CTLREFLDPTTAVC

SEQ ID NO: 491 - protein, 14 aa, Artificial sequence
  Synthetic peptide
CTLKEWLVSHEVWC

SEQ ID NO: 492 - protein, 14 aa, Artificial sequence
  Synthetic peptide
  Misc feature (8)..(11): Xaa=any amino acid or nothing
  Misc feature (12)..(13): Xaa=any amino acid
CTLREWLXXXXXXC

SEQ ID NO: 493 - protein, 10 aa, Artificial sequence
  Synthetic peptide
REGPTLRQWM

SEQ ID NO: 494 - protein, 10 aa, Artificial sequence
  Synthetic peptide
EGPTLRQWLA

SEQ ID NO: 495 - protein, 10 aa, Artificial sequence
  Synthetic peptide
ERGPFWAKAC

SEQ ID NO: 496 - protein, 10 aa, Artificial sequence
  Synthetic peptide
REGPRCVMWM

SEQ ID NO: 497 - protein, 14 aa, Artificial sequence
  Synthetic peptide
CGTEGPTLSTWLDC

SEQ ID NO: 498 - protein, 14 aa, Artificial sequence
  Synthetic peptide
CEQDGPTLLEWLKC

SEQ ID NO: 499 - protein, 14 aa, Artificial sequence
  Synthetic peptide
CELVGPSLMSWLTC

SEQ ID NO: 500 - protein, 14 aa, Artificial sequence
  Synthetic peptide
CLTGPFVTQWLYEC

SEQ ID NO: 501 - protein, 14 aa, Artificial sequence
  Synthetic peptide
CRAGPTLLEWLTLC

SEQ ID NO: 502 - protein, 14 aa, Artificial sequence
  Synthetic peptide
CADGPTLREWISFC

SEQ ID NO: 503 - protein, 15 aa, Artificial sequence
  Synthetic peptide
  Misc feature (2)..(2): Xaa=any amino acid or nothing
  Misc feature (3)..(3): Xaa=any amino acid
  Misc feature (13)..(13): Xaa=any amino acid or nothing
  Misc feature (14)..(14): Xaa=any amino acid
CXXEGPTLREWLXXC

SEQ ID NO: 504 - protein, 16 aa, Artificial sequence
  Synthetic peptide
GGCTLREWLHGGFCGG

SEQ ID NO: 505 - protein, 18 aa, Artificial sequence
  Synthetic peptide
GGCADGPTLREWISFCGG

SEQ ID NO: 506 - protein, 19 aa, Artificial sequence
  Synthetic peptide
GNADGPTLRQWLEGRRPKN

SEQ ID NO: 507 - protein, 19 aa, Artificial sequence
  Synthetic peptide
LAIEGPTLRQWLHGNGRDT

SEQ ID NO: 508 - protein, 19 aa, Artificial sequence
  Synthetic peptide
HGRVGPTLREWKTQVATKK

SEQ ID NO: 509 - protein, 18 aa, Artificial sequence
  Synthetic peptide
TIKGPTLRQWLKSREHTS

SEQ ID NO: 510 - protein, 18 aa, Artificial sequence
  Synthetic peptide
ISDGPTLKEWLSVTRGAS

SEQ ID NO: 511 - protein, 18 aa, Artificial sequence
  Synthetic peptide
SIEGPTLREWLTSRTPHS

SEQ ID NO: 512 - protein, 5 aa, Artificial sequence
  Synthetic peptide
EEDCK

SEQ ID NO: 513 - protein, 5 aa, Artificial sequence
  Synthetic peptide
  Misc feature (1)..(5): Dimeric peptide
EEDCK

SEQ ID NO: 514 - protein, 4 aa, Artificial sequence
  Synthetic peptide
  Misc feature (3)..(4): Non-amino acid moiety between residues 3 and 4
EEDK

SEQ ID NO: 515 - protein, 4 aa, Artificial sequence
  Synthetic peptide
  Misc feature (1)..(4): Dimeric peptide
  Misc feature (3)..(4): Non-amino acid moiety between residues 3 and 4
EEDK

SEQ ID NO: 516 - protein, 4 aa, Artificial sequence
  Synthetic peptide
  Phosphorylation (1)..(1): Phosphorylated Glu at position 1
  Misc feature (3)..(4): Non-amino acid moiety between residues 3 and 4
EEDK

SEQ ID NO: 517 - protein, 4 aa, Artificial sequence
  Synthetic peptide
  Phosphorylation (1)..(1): Phosphorylated Glu at position 1
  Misc feature (1)..(4): Dimeric peptide
  Misc feature (3)..(4): Non-amino acid moiety between residues 3 and 4
EEDK

SEQ ID NO: 518 - protein, 3 aa, Artificial sequence
  Synthetic peptide
  Misc feature (1)..(1): Pipecolic acid is before residue 1
  Misc feature (2)..(3): Non-amino acid moiety between residues 2 and 3
SDK

SEQ ID NO: 519 - protein, 3 aa, Artificial sequence
  Synthetic peptide
  MISC FEATURE (1)..(1): Pipecolic acid is before residue 1
  MISC FEATURE (1)..(3): Dimeric peptide
  MISC FEATURE (2)..(3): Non-amino acid moiety between residues 2 and 3
SDK

SEQ ID NO: 520 - protein, 5 aa, Artificial sequence
  Synthetic peptide
  MISC FEATURE (1)..(5): Dimeric peptide
  MISC FEATURE (5)..(5): Non-amino acid moiety after residue 5
EEDCK

SEQ ID NO: 521 - protein, 5 aa, Artificial sequence
  Synthetic peptide
  MISC FEATURE (1)..(5): Dimeric peptide
  MISC FEATURE (4)..(4): Xaa = any amino acid
  MISC FEATURE (5)..(5): Non-amino acid moiety after residue 5
EEDXK

SEQ ID NO: 522 - protein, 11 aa, Artificial sequence
  Synthetic peptide
YCFTASENHCY

SEQ ID NO: 523 - protein, 11 aa, Artificial sequence
  Synthetic peptide
YCFTNSENHCY

SEQ ID NO: 524 - protein, 11 aa, Artificial sequence
  Synthetic peptide
YCFTRSENHCY

SEQ ID NO: 525 - protein, 9 aa, Artificial sequence
  Synthetic peptide
FCASENHCY

SEQ ID NO: 526 - protein, 9 aa, Artificial sequence
  Synthetic peptide
YCASENHCY

SEQ ID NO: 527 - protein, 9 aa, Artificial sequence
  Synthetic peptide
FCNSENHCY

SEQ ID NO: 528 - protein, 9 aa, Artificial sequence
  Synthetic peptide
FCNSENRCY

SEQ ID NO: 529 - protein, 10 aa, Artificial sequence
  Synthetic peptide
FCNSVENRCY

SEQ ID NO: 530 - protein, 11 aa, Artificial sequence
  Synthetic peptide
YCSQSVSNDCF

SEQ ID NO: 531 - protein, 9 aa, Artificial sequence
  Synthetic peptide
FCVSNDRCY

SEQ ID NO: 532 - protein, 11 aa, Artificial sequence
  Synthetic peptide
YCRKELGQVCY

SEQ ID NO: 533 - protein, 9 aa, Artificial sequence
  Synthetic peptide
YCKEPGQCY

SEQ ID NO: 534 - protein, 9 aa, Artificial sequence
  Synthetic peptide
YCRKEMGCY

SEQ ID NO: 535 - protein, 9 aa, Artificial sequence
  Synthetic peptide
FCRKEMGCY

SEQ ID NO: 536 - protein, 9 aa, Artificial sequence
  Synthetic peptide
YCWSQNLCY

SEQ ID NO: 537 - protein, 10 aa, Artificial sequence
  Synthetic peptide
YCELSQYLCY

SEQ ID NO: 538 - protein, 9 aa, Artificial sequence
  Synthetic peptide
YCWSQNYCY

SEQ ID NO: 539 - protein, 9 aa, Artificial sequence
  Synthetic peptide
YCWSQYLCY

SEQ ID NO: 540 - protein, 15 aa, Artificial sequence
  Synthetic peptide
DFLPHYKNTSLGHRP

SEQ ID NO: 541 - protein, 7 aa, Artificial sequence
  Synthetic peptide
  Misc feature (2)..(2): Xaa=any amino acid
  Misc feature (5)..(5): Xaa=any amino acid
  Misc feature (7)..(7): Xaa=any amino acid
RXETXWX

SEQ ID NO: 542 - protein, 7 aa, Artificial sequence
  Synthetic peptide
  Misc feature (2)..(2): Xaa=any amino acid
  Misc feature (5)..(5): Xaa=any amino acid
  Misc feature (7)..(7): Xaa=any amino acid
RXETXWX

SEQ ID NO: 543 - protein, 5 aa, Artificial sequence
  Synthetic peptide
  Misc feature (5)..(5): Xaa=any amino acid
RGDGX

SEQ ID NO: 544 - protein, 7 aa, Artificial sequence
  Synthetic peptide
  Misc feature (6)..(6): Xaa=any amino acid
CRGDGXC

SEQ ID NO: 545 - protein, 9 aa, Artificial sequence
  Synthetic peptide
  Misc feature (2)..(3): Xaa=any amino acid
  Misc feature (7)..(8): Xaa=any amino acid
CXXRLDXXC

SEQ ID NO: 546 - protein, 9 aa, Artificial sequence
  Synthetic peptide
CARRLDAPC

SEQ ID NO: 547 - protein, 9 aa, Artificial sequence
  Synthetic peptide
CPSRLDSPC

SEQ ID NO: 548 - protein, 9 aa, Artificial sequence
  Synthetic peptide
  Misc feature (1)..(3): Xaa=any amino acid
  Misc feature (7)..(9): Xaa=any amino acid
XXXRGDXXX

SEQ ID NO: 549 - protein, 9 aa, Artificial sequence
  Synthetic peptide
  Misc feature (2)..(2): Xaa=any amino acid
  Misc feature (8)..(8): Xaa=any amino acid
CXCRGDCXC

SEQ ID NO: 550 - protein, 9 aa, Artificial sequence
  Synthetic peptide
CDCRGDCFC

SEQ ID NO: 551 - protein, 9 aa, Artificial sequence
  Synthetic peptide
CDCRGDCLC

SEQ ID NO: 552 - protein, 9 aa, Artificial sequence
  Synthetic peptide
CLCRGDCIC

SEQ ID NO: 553 - protein, 16 aa, Artificial sequence
  Synthetic peptide
  Misc feature (1)..(2): Xaa=any amino acid
  Misc feature (5)..(7): Xaa=any amino acid
  Misc feature (8)..(11): Xaa=any amino acid or nothing
  Misc feature (12)..(12): Xaa=any amino acid
  Misc feature (13)..(16): Xaa=any amino acid or nothing
XXDDXXXXXXXXXXXX

SEQ ID NO: 554 - protein, 19 aa, Artificial sequence
  Synthetic peptide
  Misc feature (1)..(3): Xaa=any amino acid
  Misc feature (6)..(9): Xaa=any amino acid
  Misc feature (10)..(13): Xaa=any amino acid or nothing
  Misc feature (14)..(14): Xaa=any amino acid
  Misc feature (15)..(19): Xaa=any amino acid or nothing
XXXDDXXXXXXXXXXXXXX

SEQ ID NO: 555 - protein, 8 aa, Artificial sequence
  Synthetic peptide
CWDDGWLC

SEQ ID NO: 556 - protein, 9 aa, Artificial sequence
  Synthetic peptide
CWDDLWWLC

SEQ ID NO: 557 - protein, 8 aa, Artificial sequence
  Synthetic peptide
CWDDGLMC

SEQ ID NO: 558 - protein, 8 aa, Artificial sequence
  Synthetic peptide
CWDDGWMC

SEQ ID NO: 559 - protein, 9 aa, Artificial sequence
  Synthetic peptide
CSWDDGWLC

SEQ ID NO: 560 - protein, 9 aa, Artificial sequence
  Synthetic peptide
CPDDLWWLC

SEQ ID NO: 561 - protein, 13 aa, Artificial sequence
  Synthetic peptide
CGRECPRLCQSSC

SEQ ID NO: 562 - protein, 13 aa, Artificial sequence
  Synthetic peptide
CNGRCVSGCAGRC

SEQ ID NO: 563 - protein, 8 aa, Artificial sequence
  Synthetic peptide
CLSGSLSC

SEQ ID NO: 564 - protein, 6 aa, Artificial sequence
  Synthetic peptide
NGRAHA

SEQ ID NO: 565 - protein, 5 aa, Artificial sequence
  Synthetic peptide
CNGRC

SEQ ID NO: 566 - protein, 9 aa, Artificial sequence
  Synthetic peptide
CDCRGDCFC

SEQ ID NO: 567 - protein, 7 aa, Artificial sequence
  Synthetic peptide
CGSLVRC

SEQ ID NO: 568 - protein, 5 aa, Artificial sequence
  Synthetic peptide
  Misc feature (3)..(4): Xaa=any amino acid
DLXXL

SEQ ID NO: 569 - protein, 12 aa, Artificial sequence
  Synthetic peptide
RTDLDSLRTYTL

SEQ ID NO: 570 - protein, 10 aa, Artificial sequence
  Synthetic peptide
RTDLDSLRTY

SEQ ID NO: 571 - protein, 9 aa, Artificial sequence
  Synthetic peptide
RTDLDSLRT

SEQ ID NO: 572 - protein, 8 aa, Artificial sequence
  Synthetic peptide
RTDLDSLR

SEQ ID NO: 573 - protein, 12 aa, Artificial sequence
  Synthetic peptide
GDLDLLKLRLTL

SEQ ID NO: 574 - protein, 12 aa, Artificial sequence
  Synthetic peptide
GDLHSLRQLLSR

SEQ ID NO: 575 - protein, 12 aa, Artificial sequence
  Synthetic peptide
RDDLHMLRLQLW

SEQ ID NO: 576 - protein, 12 aa, Artificial sequence
  Synthetic peptide
SSDLHALKKRYG

SEQ ID NO: 577 - protein, 12 aa, Artificial sequence
  Synthetic peptide
RGDLKQLSELTW

SEQ ID NO: 578 - protein, 12 aa, Artificial sequence
  Synthetic peptide
RGDLAALSAPPV

SEQ ID NO: 579 - protein, 12 aa, Artificial sequence
  Synthetic peptide
DITWDQLWDLMK

SEQ ID NO: 580 - protein, 12 aa, Artificial sequence
  Synthetic peptide
DITWDELWKIMN

SEQ ID NO: 581 - protein, 12 aa, Artificial sequence
  Synthetic peptide
DYTWFELWDMMQ

SEQ ID NO: 582 - protein, 12 aa, Artificial sequence
  Synthetic peptide
QITWAQLWNMMK

SEQ ID NO: 583 - protein, 12 aa, Artificial sequence
  Synthetic peptide
DMTWHDLWTLMS

SEQ ID NO: 584 - protein, 12 aa, Artificial sequence
  Synthetic peptide
DYSWHDLWEMMS

SEQ ID NO: 585 - protein, 12 aa, Artificial sequence
  Synthetic peptide
EITWDQLWEVMN

SEQ ID NO: 586 - protein, 12 aa, Artificial sequence
  Synthetic peptide
HVSWEQLWDIMN

SEQ ID NO: 587 - protein, 12 aa, Artificial sequence
  Synthetic peptide
HITWDQLWRIMT

SEQ ID NO: 588 - protein, 13 aa, Artificial sequence
  Synthetic peptide
RNMSWLELWEHMK

SEQ ID NO: 589 - protein, 18 aa, Artificial sequence
  Synthetic peptide
AEWTWDQLWHVMNPAESQ

SEQ ID NO: 590 - protein, 14 aa, Artificial sequence
  Synthetic peptide
HRAEWLALWEQMSP

SEQ ID NO: 591 - protein, 14 aa, Artificial sequence
  Synthetic peptide
KKEDWLALWRIMSV

SEQ ID NO: 592 - protein, 11 aa, Artificial sequence
  Synthetic peptide
ITWDQLWDLMK

SEQ ID NO: 593 - protein, 12 aa, Artificial sequence
  Synthetic peptide
DITWDQLWDLMK

SEQ ID NO: 594 - protein, 12 aa, Artificial sequence
  Synthetic peptide
DITWDQLWDLMK

SEQ ID NO: 595 - protein, 12 aa, Artificial sequence
  Synthetic peptide
DITWDQLWDLMK

SEQ ID NO: 596 - protein, 16 aa, Artificial sequence
  Synthetic peptide
CQNRYTDLVAIQNKNE

SEQ ID NO: 597 - protein, 17 aa, Artificial sequence
  Synthetic peptide
AENWADNEPNNKRNNED

SEQ ID NO: 598 - protein, 19 aa, Artificial sequence
  Synthetic peptide
RKNNKTWTWVGTKKALTNE

SEQ ID NO: 599 - protein, 13 aa, Artificial sequence
  Synthetic peptide
KKALTNEAENWAD

SEQ ID NO: 600 - protein, 16 aa, Artificial sequence
  Synthetic peptide
  Misc feature (3)..(3): Xaa=any amino acid
  Misc feature (15)..(15): Xaa=any amino acid
CQXRYTDLVAIQNKXE

SEQ ID NO: 601 - protein, 19 aa, Artificial sequence
  Synthetic peptide
  Misc feature (3)..(3): Xaa=any amino acid
  Misc feature (5)..(6): Xaa=any amino acid
  Misc feature (13)..(13): Xaa=any amino acid
  Misc feature (15)..(15): Xaa=any amino acid
RKXNXXWTWVGTXKXLTEE

SEQ ID NO: 602 - protein, 17 aa, Artificial sequence
  Synthetic peptide
  Misc feature (13)..(13): Xaa=any amino acid
  Misc feature (15)..(15): Xaa=any amino acid
AENWADGEPNNKXNXED

SEQ ID NO: 603 - protein, 16 aa, Artificial sequence
  Synthetic peptide
  Misc feature (2)..(4): Xaa=any amino acid
  Misc feature (7)..(7): Xaa=any amino acid
  Misc feature (15)..(15): Xaa=any amino acid
CXXXYTXLVAIQNKXE

SEQ ID NO: 604 - protein, 19 aa, Artificial sequence
  Synthetic peptide
  Misc feature (3)..(6): Xaa=any amino acid
  Misc feature (8)..(8): Xaa=any amino acid
  Misc feature (13)..(13): Xaa=any amino acid
  Misc feature (15)..(15): Xaa=any amino acid
  Misc feature (18)..(18): Xaa=any amino acid
RKXXXXWXWVGTXKXLTXE

SEQ ID NO: 605 - protein, 16 aa, Artificial sequence
  Synthetic peptide
  Misc feature (2)..(2): Xaa=any amino acid
  Misc feature (5)..(7): Xaa=any amino acid
  Misc feature (12)..(14): Xaa=any amino acid
AXNWXXXEPNNXXXED

SEQ ID NO: 606 - protein, 13 aa, Artificial sequence
  Synthetic peptide
  Misc feature (1)..(1): Xaa=any amino acid
  Misc feature (3)..(3): Xaa=any amino acid
  Misc feature (6)..(6): Xaa=any amino acid
  Misc feature (9)..(9): Xaa=any amino acid
  Misc feature (12)..(13): Xaa=any amino acid
XKXKTXEAXNWXX

SEQ ID NO: 607 - protein, 33 aa, Artificial sequence
  Synthetic peptide
GFFALIPKIISSPLFKTLLSAVGSALSSSGGQQ

SEQ ID NO: 608 - protein, 33 aa, Artificial sequence
  Synthetic peptide
GFFALIPKIISSPLFKTLLSAVGSALSSSGGQE

SEQ ID NO: 609 - protein, 22 aa, Artificial sequence
  Synthetic peptide
GFFALIPKIISSPLFKTLLSAV

SEQ ID NO: 610 - protein, 22 aa, Artificial sequence
  Synthetic peptide
GFFALIPKIISSPLFKTLLSAV

SEQ ID NO: 611 - protein, 23 aa, Artificial sequence
  Synthetic peptide
KGFFALIPKIISSPLFKTLLSAV

SEQ ID NO: 612 - protein, 24 aa, Artificial sequence
  Synthetic peptide
KKGFFALIPKIISSPLFKTLLSAV

SEQ ID NO: 613 - protein, 24 aa, Artificial sequence
  Synthetic peptide
KKGFFALIPKIISSPLFKTLLSAV

SEQ ID NO: 614 - protein, 11 aa, Artificial sequence
  Synthetic peptide
GFFALIPKIIS

SEQ ID NO: 615 - protein, 26 aa, Artificial sequence
  Synthetic peptide
GIGAVLKVLTTGLPALISWIKRKRQQ

SEQ ID NO: 616 - protein, 26 aa, Artificial sequence
  Synthetic peptide
GIGAVLKVLTTGLPALISWIKRKRQQ

SEQ ID NO: 617 - protein, 26 aa, Artificial sequence
  Synthetic peptide
GIGAVLKVLTTGLPALISWIKRKRQQ

SEQ ID NO: 618 - protein, 22 aa, Artificial sequence
  Synthetic peptide
GIGAVLKVLTTGLPALISWIKR

SEQ ID NO: 619 - protein, 19 aa, Artificial sequence
  Synthetic peptide
AVLKVLTTGLPALISWIKR

SEQ ID NO: 620 - protein, 12 aa, Artificial sequence
  Synthetic peptide
KLLLLLKLLLLK

SEQ ID NO: 621 - protein, 12 aa, Artificial sequence
  Synthetic peptide
KLLLKLLLKLLK

SEQ ID NO: 622 - protein, 12 aa, Artificial sequence
  Synthetic peptide
KLLLKLKLKLLK

SEQ ID NO: 623 - protein, 12 aa, Artificial sequence
  Synthetic peptide
KKLLKLKLKLKK

SEQ ID NO: 624 - protein, 12 aa, Artificial sequence
  Synthetic peptide
KLLLKLLLKLLK

SEQ ID NO: 625 - protein, 12 aa, Artificial sequence
  Synthetic peptide
KLLLKLKLKLLK

SEQ ID NO: 626 - protein, 6 aa, Artificial sequence
  Synthetic peptide
KLLLLK

SEQ ID NO: 627 - protein, 8 aa, Artificial sequence
  Synthetic peptide
KLLLKLLK

SEQ ID NO: 628 - protein, 12 aa, Artificial sequence
  Synthetic peptide
KLLLKLKLKLLK

SEQ ID NO: 629 - protein, 12 aa, Artificial sequence
  Synthetic peptide
KLLLKLKLKLLK

SEQ ID NO: 630 - protein, 12 aa, Artificial sequence
  Synthetic peptide
KLLLKLKLKLLK

SEQ ID NO: 631 - protein, 12 aa, Artificial sequence
  Synthetic peptide
KAAAKAAAKAAK

SEQ ID NO: 632 - protein, 12 aa, Artificial sequence
  Synthetic peptide
KVVVKVVVKVVK

SEQ ID NO: 633 - protein, 12 aa, Artificial sequence
  Synthetic peptide
KVVVKVKVKVVK

SEQ ID NO: 634 - protein, 11 aa, Artificial sequence
  Synthetic peptide
KVVVKVKVKVK

SEQ ID NO: 635 - protein, 12 aa, Artificial sequence
  Synthetic peptide
KVVVKVKVKVVK

SEQ ID NO: 636 - protein, 6 aa, Artificial sequence
  Synthetic peptide
KLILKL

SEQ ID NO: 637 - protein, 6 aa, Artificial sequence
  Synthetic peptide
KVLHLL

SEQ ID NO: 638 - protein, 6 aa, Artificial sequence
  Synthetic peptide
LKLRLL

SEQ ID NO: 639 - protein, 6 aa, Artificial sequence
  Synthetic peptide
KPLHLL

SEQ ID NO: 640 - protein, 8 aa, Artificial sequence
  Synthetic peptide
KLILKLVR

SEQ ID NO: 641 - protein, 8 aa, Artificial sequence
  Synthetic peptide
KVFHLLHL

SEQ ID NO: 642 - protein, 8 aa, Artificial sequence
  Synthetic peptide
HKFRILKL

SEQ ID NO: 643 - protein, 8 aa, Artificial sequence
  Synthetic peptide
KPFHILHL

SEQ ID NO: 644 - protein, 12 aa, Artificial sequence
  Synthetic peptide
KIIIKIKIKIIK

SEQ ID NO: 645 - protein, 12 aa, Artificial sequence
  Synthetic peptide
KIIIKIKIKIIK

SEQ ID NO: 646 - protein, 12 aa, Artificial sequence
  Synthetic peptide
KIIIKIKIKIIK

SEQ ID NO: 647 - protein, 12 aa, Artificial sequence
  Synthetic peptide
KIPIKIKIKIPK

SEQ ID NO: 648 - protein, 12 aa, Artificial sequence
  Synthetic peptide
KIPIKIKIKIVK

SEQ ID NO: 649 - protein, 12 aa, Artificial sequence
  Synthetic peptide
RIIIRIRIRIIR

SEQ ID NO: 650 - protein, 12 aa, Artificial sequence
  Synthetic peptide
RIIIRIRIRIIR

SEQ ID NO: 651 - protein, 12 aa, Artificial sequence
  Synthetic peptide
RIIIRIRIRIIR

SEQ ID NO: 652 - protein, 12 aa, Artificial sequence
  Synthetic peptide
RIVIRIRIRLIR

SEQ ID NO: 653 - protein, 12 aa, Artificial sequence
  Synthetic peptide
RIIVRIRLRIIR

SEQ ID NO: 654 - protein, 12 aa, Artificial sequence
  Synthetic peptide
RIGIRLRVRIIR

SEQ ID NO: 655 - protein, 12 aa, Artificial sequence
  Synthetic peptide
KIVIRIRIRLIR

SEQ ID NO: 656 - protein, 12 aa, Artificial sequence
  Synthetic peptide
RIAVKWRLRFIK

SEQ ID NO: 657 - protein, 12 aa, Artificial sequence
  Synthetic peptide
KIGWKLRVRIIR

SEQ ID NO: 658 - protein, 12 aa, Artificial sequence
  Synthetic peptide
KKIGWLIIRVRR

SEQ ID NO: 659 - protein, 14 aa, Artificial sequence
  Synthetic peptide
RIVIRIRIRLIRIR

SEQ ID NO: 660 - protein, 14 aa, Artificial sequence
  Synthetic peptide
RIIVRIRLRIIRVR

SEQ ID NO: 661 - protein, 14 aa, Artificial sequence
  Synthetic peptide
RIGIRLRVRIIRRV

SEQ ID NO: 662 - protein, 16 aa, Artificial sequence
  Synthetic peptide
KIVIRIRARLIRIRIR

SEQ ID NO: 663 - protein, 16 aa, Artificial sequence
  Synthetic peptide
RIIVKIRLRIIKKIRL

SEQ ID NO: 664 - protein, 16 aa, Artificial sequence
  Synthetic peptide
KIGIKARVRIIRVKII

SEQ ID NO: 665 - protein, 16 aa, Artificial sequence
  Synthetic peptide
RIIVHIRLRIIHHIRL

SEQ ID NO: 666 - protein, 16 aa, Artificial sequence
  Synthetic peptide
HIGIKAHVRIIRVHII

SEQ ID NO: 667 - protein, 16 aa, Artificial sequence
  Synthetic peptide
RIYVKIHLRYIKKIRL

SEQ ID NO: 668 - protein, 16 aa, Artificial sequence
  Synthetic peptide
KIGHKARVHIIRYKII

SEQ ID NO: 669 - protein, 16 aa, Artificial sequence
  Synthetic peptide
RIYVKPHPRYIKKIRL

SEQ ID NO: 670 - protein, 16 aa, Artificial sequence
  Synthetic peptide
KPGHKARPHIIRYKII

SEQ ID NO: 671 - protein, 19 aa, Artificial sequence
  Synthetic peptide
KIVIRIRIRLIRIRIRKIV

SEQ ID NO: 672 - protein, 19 aa, Artificial sequence
  Synthetic peptide
RIIVKIRLRIIKKIRLIKK

SEQ ID NO: 673 - protein, 19 aa, Artificial sequence
  Synthetic peptide
KIGWKLRVRIIRVKIGRLR

SEQ ID NO: 674 - protein, 25 aa, Artificial sequence
  Synthetic peptide
KIVIRIRIRLIRIRIRKIVKVKRIR

SEQ ID NO: 675 - protein, 26 aa, Artificial sequence
  Synthetic peptide
RFAVKIRLRIIKKIRLIKKIRKRVIK

SEQ ID NO: 676 - protein, 30 aa, Artificial sequence
  Synthetic peptide
KAGWKLRVRIIRVKIGRLRKIGWKKRVRIK

SEQ ID NO: 677 - protein, 16 aa, Artificial sequence
  Synthetic peptide
RIYVKPHPRYIKKIRL

SEQ ID NO: 678 - protein, 16 aa, Artificial sequence
  Synthetic peptide
KPGHKARPHIIRYKII

SEQ ID NO: 679 - protein, 19 aa, Artificial sequence
  Synthetic peptide
KIVIRIRIRLIRIRIRKIV

SEQ ID NO: 680 - protein, 19 aa, Artificial sequence
  Synthetic peptide
RIIVKIRLRIIKKIRLIKK

SEQ ID NO: 681 - protein, 16 aa, Artificial sequence
  Synthetic peptide
RIYVSKISIYIKKIRL

SEQ ID NO: 682 - protein, 19 aa, Artificial sequence
  Synthetic peptide
KIVIFTRIRLTSIRIRSIV

SEQ ID NO: 683 - protein, 16 aa, Artificial sequence
  Synthetic peptide
KPIHKARPTIIRYKMI

SEQ ID NO: 684 - protein, 25 aa, Artificial sequence
  Synthetic peptide
CKGFFALIPKIISSPLFKTLLSAVC

SEQ ID NO: 685 - protein, 26 aa, Artificial sequence
  Synthetic peptide
CKKGFFALIPKIISSPLFKTLLSAVC

SEQ ID NO: 686 - protein, 27 aa, Artificial sequence
  Synthetic peptide
CKKKGFFALIPKIISSPLFKTLLSAVC

SEQ ID NO: 687 - protein, 16 aa, Artificial sequence
  Synthetic peptide
CRIVIRIRIRLIRIRC

SEQ ID NO: 688 - protein, 18 aa, Artificial sequence
  Synthetic peptide
CKPGHKARPHIIRYKIIC

SEQ ID NO: 689 - protein, 28 aa, Artificial sequence
  Synthetic peptide
CRFAVKIRLRIIKKIRLIKKIRKRVIKC

SEQ ID NO: 690 - protein, 13 aa, Artificial sequence
  Synthetic peptide
KLLLKLLLKLLKC

SEQ ID NO: 691 - protein, 12 aa, Artificial sequence
  Synthetic peptide
KLLLKLLLKLLK

SEQ ID NO: 692 - protein, 13 aa, Artificial sequence
  Synthetic peptide
KLLLKLKLKLLKC

SEQ ID NO: 693 - protein, 12 aa, Artificial sequence
  Synthetic peptide
KLLLKLLLKLLK

SEQ ID NO: 694 - protein, 28 aa, Artificial sequence
  Synthetic peptide
HSDAVFYDNYTRLRKQMAVKKYLNSILN

SEQ ID NO: 695 - protein, 29 aa, Artificial sequence
  Synthetic peptide
  Misc feature (1)..(1): Xaa=Norleucine
XHSDAVFYDNYTRLRKQMAVKKYLNSILN

SEQ ID NO: 696 - protein, 11 aa, Artificial sequence
  Synthetic peptide
  Misc feature (1)..(1): Xaa=Ala, Val, Lys, D-Lys, Orn, or nothing
  Misc feature (2)..(2): If residue 1 is Ala, Xaa=Val or nothing; if residue 1 is Val, Xaa=Ala, Lys or nothing; if residue 1 not Ala or Val, Xaa=nothing
  Misc feature (3)..(3): If residue 2 is Val or Ala, Xaa=Lys or nothing; if residue 2 is not Val or Ala, Xaa=nothing
  Misc feature (4)..(4): Xaa=L-Lys, D-Lys, or Orn
  Misc feature (5)..(5): Xaa=L-Tyr, D-Tyr, Phe, Trp, or p-amino phenylalanine
  Misc feature (6)..(6): Xaa=Ala, D-Ala, Ile, D-Ile, Leu, D-Leu, Met, D-Met, Val, D-Val, Nva, D-Nva, Nle, or D-Nle
  Misc feature (7)..(7): Xaa=Asn, Ser, Ile, Tyr, Leu, D-Ala, Nle, or nothing
  Misc feature (8)..(8): If residue 7 is Asn, Xaa=Ser or nothing; if residue 7 is not Asn, Xaa=nothing
  Misc feature (9)..(9): If residue 8 is Ser, Xaa=Ile, Tyr, or nothing; if residue 8 is not Ser, Xaa=nothing
  Misc feature (10)..(10): If residue 9 is Ile or Tyr, Xaa=Leu; if residue 9 is not Ile or Tyr, Xaa=nothing
  Misc feature (11)..(11): If residue 10 is Leu, Xaa=Asn; if residue 10 is not Leu, Xaa=nothing
XXXXXXXXXXX

SEQ ID NO: 697 - protein, 11 aa, Artificial sequence
  Synthetic peptide
  Misc feature (1)..(4): Xaa=Asn, Ala, D-Ala, Ile, D-Ile, Leu, D-Leu, Met, D-Met, Val, D-Val, Nva, D-Nva, Nle, D-Nle, Tyr, Lys, or nothing
  Misc feature (5)..(5): Xaa=Asn, Ala, D-Ala, Ile, D-Ile, Leu, D-Leu, Met, D-Met, Val, D-Val, Nva, D-Nva, Nle, D-Nle, Tyr, or nothing
  Misc feature (6)..(6): Xaa=Ala, D-Ala, Ile, D-Ile, Leu, D-Leu, Met, D-Met, Val, D-Val, Nva, D-Nva, Nle, D-Nle, or nothing
  Misc feature (7)..(7): Xaa=Asn or nothing
  Misc feature (9)..(9): Xaa=Ile or Tyr
XXXXXXXSXLN

SEQ ID NO: 698 - skipped

SEQ ID NO: 699 - protein, 4 aa, Artificial sequence
  Synthetic peptide
KKYL

SEQ ID NO: 700 - protein, 5 aa, Artificial sequence
  Synthetic peptide
NSILN

SEQ ID NO: 701 - protein, 4 aa, Artificial sequence
  Synthetic peptide
KKYL

SEQ ID NO: 702 - protein, 4 aa, Artificial sequence
  Synthetic peptide
KKYA

SEQ ID NO: 703 - protein, 6 aa, Artificial sequence
  Synthetic peptide
AVKKYL

SEQ ID NO: 704 - protein, 5 aa, Artificial sequence
  Synthetic peptide
NSILN

SEQ ID NO: 705 - protein, 4 aa, Artificial sequence
  Synthetic peptide
KKYV

SEQ ID NO: 706 - protein, 3 aa, Artificial sequence
  Synthetic peptide
  Misc feature (2)..(3): A lauroyl moiety is between residues 2 and 3
SIN

SEQ ID NO: 707 - protein, 5 aa, Artificial sequence
  Synthetic peptide
  Misc feature (5)..(5): Xaa=Norleucine
KKYLX

SEQ ID NO: 708 - protein, 5 aa, Artificial sequence
  Synthetic peptide
NSYLN

SEQ ID NO: 709 - protein, 5 aa, Artificial sequence
  Synthetic peptide
NSIYN

SEQ ID NO: 710 - protein, 11 aa, Artificial sequence
  Synthetic peptide
KKYLPPNSILN

SEQ ID NO: 711 - protein, 4 aa, Artificial sequence
  Synthetic peptide
  Binding (1)..(1): A lauroyl moiety is bound to residue 1
KKYL

SEQ ID NO: 712 - protein, 4 aa, Artificial sequence
  Synthetic peptide
  Binding (1)..(1): A caproyl moiety is bound to residue 1
KKYL

SEQ ID NO: 713 - protein, 3 aa, Artificial sequence
  Synthetic peptide
KYL

SEQ ID NO: 714 - protein, 4 aa, Artificial sequence
  Synthetic peptide
  Misc feature (4)..(4): Xaa=Norleucine
KKYX

SEQ ID NO: 715 - protein, 5 aa, Artificial sequence
  Synthetic peptide
VKKYL

SEQ ID NO: 716 - protein, 6 aa, Artificial sequence
  Synthetic peptide
LNSILN

SEQ ID NO: 717 - protein, 7 aa, Artificial sequence
  Synthetic peptide
YLNSILN

SEQ ID NO: 718 - protein, 5 aa, Artificial sequence
  Synthetic peptide
KKYLN

SEQ ID NO: 719 - protein, 6 aa, Artificial sequence
  Synthetic peptide
KKYLNS

SEQ ID NO: 720 - protein, 7 aa, Artificial sequence
  Synthetic peptide
KKYLNSI

SEQ ID NO: 721 - protein, 8 aa, Artificial sequence
  Synthetic peptide
KKYLNSIL

SEQ ID NO: 722 - protein, 4 aa, Artificial sequence
  Synthetic peptide
KKYL

SEQ ID NO: 723 - protein, 5 aa, Artificial sequence
  Synthetic peptide
KKYDA

SEQ ID NO: 724 - protein, 6 aa, Artificial sequence
  Synthetic peptide
AVKKYL

SEQ ID NO: 725 - protein, 5 aa, Artificial sequence
  Synthetic peptide
NSILN

SEQ ID NO: 726 - protein, 4 aa, Artificial sequence
  Synthetic peptide
KKYV

SEQ ID NO: 727 - protein, 3 aa, Artificial sequence
  Synthetic peptide
  Misc feature (2)..(3): A lauroyl moiety is between residues 2 and 3
SIN

SEQ ID NO: 728 - protein, 5 aa, Artificial sequence
  Synthetic peptide
NSYLN

SEQ ID NO: 729 - protein, 5 aa, Artificial sequence
  Synthetic peptide
NSIYN

SEQ ID NO: 730 - protein, 5 aa, Artificial sequence
  Synthetic peptide
  Misc feature (5)..(5): Xaa=Norleucine
KKYLX

SEQ ID NO: 731 - protein, 11 aa, Artificial sequence
  Synthetic peptide
KKYLPPNSILN

SEQ ID NO: 732 - protein, 4 aa, Artificial sequence
  Synthetic peptide
KKYL

SEQ ID NO: 733 - protein, 5 aa, Artificial sequence
  Synthetic peptide
KKYDA

SEQ ID NO: 734 - protein, 6 aa, Artificial sequence
  Synthetic peptide
AVKKYL

SEQ ID NO: 735 - protein, 5 aa, Artificial sequence
  Synthetic peptide
NSILN

SEQ ID NO: 736 - protein, 4 aa, Artificial sequence
  Synthetic peptide
KKYV

SEQ ID NO: 737 - protein, 3 aa, Artificial sequence
  Synthetic peptide
  Misc feature (2)..(3): A lauroyl moiety is between residues 2 and 3
SIN

SEQ ID NO: 738 - protein, 4 aa, Artificial sequence
  Synthetic peptide
  Binding (1)..(1): A lauroyl moiety is bound to residue 1
KKYL

SEQ ID NO: 739 - protein, 4 aa, Artificial sequence
  Synthetic peptide
  Binding (1)..(1): A caproyl moiety is bound to residue 1
KKYL

SEQ ID NO: 740 - protein, 3 aa, Artificial sequence
  Synthetic peptide
KYL

SEQ ID NO: 741 - protein, 3 aa, Artificial sequence
  Synthetic peptide
KYL

SEQ ID NO: 742 - protein, 4 aa, Artificial sequence
  Synthetic peptide
  Misc feature (4)..(4): Xaa=Norleucine
KKYX

SEQ ID NO: 743 - protein, 5 aa, Artificial sequence
  Synthetic peptide
VKKYL

SEQ ID NO: 744 - protein, 6 aa, Artificial sequence
  Synthetic peptide
LNSILN

SEQ ID NO: 745 - protein, 7 aa, Artificial sequence
  Synthetic peptide
YLNSILN

SEQ ID NO: 746 - protein, 5 aa, Artificial sequence
  Synthetic peptide
  Misc feature (5)..(5): Xaa=Norleucine
KKYLX

SEQ ID NO: 747 - protein, 5 aa, Artificial sequence
  Synthetic peptide
KKYLN

SEQ ID NO: 748 - protein, 6 aa, Artificial sequence
  Synthetic peptide
KKYLNS

SEQ ID NO: 749 - protein, 7 aa, Artificial sequence
  Synthetic peptide
KKYLNSI

SEQ ID NO: 750 - protein, 8 aa, Artificial sequence
  Synthetic peptide
KKYLNSIL

SEQ ID NO: 751 - protein, 6 aa, Artificial sequence
  Synthetic peptide
KKKYLD

SEQ ID NO: 752 - protein, 6 aa, Artificial sequence
  Synthetic peptide
CKKYLC

SEQ ID NO: 753 - protein, 6 aa, Artificial sequence
  Synthetic peptide
CKKYLK

SEQ ID NO: 754 - protein, 4 aa, Artificial sequence
  Synthetic peptide
KKYA

SEQ ID NO: 755 - protein, 8 aa, Artificial sequence
  Synthetic peptide
WWTDTGLW

SEQ ID NO: 756 - protein, 8 aa, Artificial sequence
  Synthetic peptide
WWTDDGLW

SEQ ID NO: 757 - protein, 12 aa, Artificial sequence
  Synthetic peptide
WWDTRGLWVWTI

SEQ ID NO: 758 - protein, 12 aa, Artificial sequence
  Synthetic peptide
FWGNDGIWLESG

SEQ ID NO: 759 - protein, 12 aa, Artificial sequence
  Synthetic peptide
DWDQFGLWRGAA

SEQ ID NO: 760 - protein, 12 aa, Artificial sequence
  Synthetic peptide
RWDDNGLWVVVL

SEQ ID NO: 761 - protein, 12 aa, Artificial sequence
  Synthetic peptide
SGMWSHYGIWMG

SEQ ID NO: 762 - protein, 12 aa, Artificial sequence
  Synthetic peptide
GGRWDQAGLWVA

SEQ ID NO: 763 - protein, 12 aa, Artificial sequence
  Synthetic peptide
KLWSEQGIWMGE

SEQ ID NO: 764 - protein, 10 aa, Artificial sequence
  Synthetic peptide
CWSMHGLWLC

SEQ ID NO: 765 - protein, 12 aa, Artificial sequence
  Synthetic peptide
GCWDNTGIWVPC

SEQ ID NO: 766 - protein, 10 aa, Artificial sequence
  Synthetic peptide
DWDTRGLWVY

SEQ ID NO: 767 - protein, 10 aa, Artificial sequence
  Synthetic peptide
SLWDENGAWI

SEQ ID NO: 768 - protein, 10 aa, Artificial sequence
  Synthetic peptide
KWDDRGLWMH

SEQ ID NO: 769 - protein, 10 aa, Artificial sequence
  Synthetic peptide
QAWNERGLWT

SEQ ID NO: 770 - protein, 10 aa, Artificial sequence
  Synthetic peptide
QWDTRGLWVA

SEQ ID NO: 771 - protein, 9 aa, Artificial sequence
  Synthetic peptide
WNVHGIWQE

SEQ ID NO: 772 - protein, 10 aa, Artificial sequence
  Synthetic peptide
SWDTRGLWVE

SEQ ID NO: 773 - protein, 10 aa, Artificial sequence
  Synthetic peptide
DWDTRGLWVA

SEQ ID NO: 774 - protein, 10 aa, Artificial sequence
  Synthetic peptide
SWGRDGLWIE

SEQ ID NO: 775 - protein, 10 aa, Artificial sequence
  Synthetic peptide
EWTDNGLWAL

SEQ ID NO: 776 - protein, 10 aa, Artificial sequence
  Synthetic peptide
SWDEKGLWSA

SEQ ID NO: 777 - protein, 10 aa, Artificial sequence
  Synthetic peptide
SWDSSGLWMD

SEQ ID NO: 778 - protein, 6 aa, Artificial sequence
  Synthetic peptide
TFSDLW

SEQ ID NO: 779 - protein, 12 aa, Artificial sequence
  Synthetic peptide
QETFSDLWKLLP

SEQ ID NO: 780 - protein, 12 aa, Artificial sequence
  Synthetic peptide
QPTFSDLWKLLP

SEQ ID NO: 781 - protein, 12 aa, Artificial sequence
  Synthetic peptide
QETFSDYWKLLP

SEQ ID NO: 782 - protein, 12 aa, Artificial sequence
  Synthetic peptide
QPTFSDYWKLLP

SEQ ID NO: 783 - protein, 12 aa, Artificial sequence
  Synthetic peptide
MPRFMDYWEGLN

SEQ ID NO: 784 - protein, 12 aa, Artificial sequence
  Synthetic peptide
VQNFIDYWTQQF

SEQ ID NO: 785 - protein, 12 aa, Artificial sequence
  Synthetic peptide
TGPAFTHYWATF

SEQ ID NO: 786 - protein, 15 aa, Artificial sequence
  Synthetic peptide
IDRAPTFRDHWFALV

SEQ ID NO: 787 - protein, 15 aa, Artificial sequence
  Synthetic peptide
PRPALVFADYWETLY

SEQ ID NO: 788 - protein, 15 aa, Artificial sequence
  Synthetic peptide
PAFSRFWSDLSAGAH

SEQ ID NO: 789 - protein, 15 aa, Artificial sequence
  Synthetic peptide
PAFSRFWSKLSAGAH

SEQ ID NO: 790 - protein, 10 aa, Artificial sequence
  Synthetic peptide
  Misc feature (2)..(2): Xaa=any amino acid
  Misc feature (4)..(4): Xaa=any amino acid
  Misc feature (8)..(9): Xaa=any amino acid
PXFXDYWXXL

SEQ ID NO: 791 - protein, 12 aa, Artificial sequence
  Synthetic peptide
QETFSDLWKLLP

SEQ ID NO: 792 - protein, 12 aa, Artificial sequence
  Synthetic peptide
QPTFSDLWKLLP

SEQ ID NO: 793 - protein, 12 aa, Artificial sequence
  Synthetic peptide
QETFSDYWKLLP

SEQ ID NO: 794 - protein, 12 aa, Artificial sequence
  Synthetic peptide
QPTFSDYWKLLP

SEQ ID NO: 795 - protein, 13 aa, Artificial sequence
  Synthetic peptide
SCVKWGKKEFCGS

SEQ ID NO: 796 - protein, 12 aa, Artificial sequence
  Synthetic peptide
SCWKYWGKECGS

SEQ ID NO: 797 - protein, 13 aa, Artificial sequence
  Synthetic peptide
SCYEWGKLRWCGS

SEQ ID NO: 798 - protein, 13 aa, Artificial sequence
  Synthetic peptide
SCLRWGKWSNCGS

SEQ ID NO: 799 - protein, 13 aa, Artificial sequence
  Synthetic peptide
SCWRWGKYQICGS

SEQ ID NO: 800 - protein, 13 aa, Artificial sequence
  Synthetic peptide
SCVSWGALKLCGS

SEQ ID NO: 801 - protein, 13 aa, Artificial sequence
  Synthetic peptide
SCIRWGQNTFCGS

SEQ ID NO: 802 - protein, 13 aa, Artificial sequence
  Synthetic peptide
SCWQWGNLKICGS

SEQ ID NO: 803 - protein, 13 aa, Artificial sequence
  Synthetic peptide
SCVRWGQLSICGS

SEQ ID NO: 804 - protein, 21 aa, Artificial sequence
  Synthetic peptide
LKKFNARRKLKGAILTTMLAK

SEQ ID NO: 805 - protein, 18 aa, Artificial sequence
  Synthetic peptide
RRWKKNFIAVSAANRFKK

SEQ ID NO: 806 - protein, 18 aa, Artificial sequence
  Synthetic peptide
RKWQKTGHAVRAIGRLSS

SEQ ID NO: 807 - protein, 14 aa, Artificial sequence
  Synthetic peptide
INLKALAALAKKIL

SEQ ID NO: 808 - protein, 18 aa, Artificial sequence
  Synthetic peptide
KIWSILAPLGTTLVKLVA

SEQ ID NO: 809 - protein, 14 aa, Artificial sequence
  Synthetic peptide
LKKLLKLLKKLLKL

SEQ ID NO: 810 - protein, 18 aa, Artificial sequence
  Synthetic peptide
LKWKKLLKLLKKLLKKLL

SEQ ID NO: 811 - protein, 17 aa, Artificial sequence
  Synthetic peptide
AEWPSLTEIKTLSHFSV

SEQ ID NO: 812 - protein, 17 aa, Artificial sequence
  Synthetic peptide
AEWPSPTRVISTTYFGS

SEQ ID NO: 813 - protein, 17 aa, Artificial sequence
  Synthetic peptide
AELAHWPPVKTVLRSFT

SEQ ID NO: 814 - protein, 17 aa, Artificial sequence
  Synthetic peptide
AEGSWLQLLNLMKQMNN

SEQ ID NO: 815 - protein, 10 aa, Artificial sequence
  Synthetic peptide
AEWPSLTEIK

SEQ ID NO: 816 - protein, 17 aa, Artificial sequence
  Synthetic peptide
SGSGVLKRPLPILPVTR

SEQ ID NO: 817 - protein, 17 aa, Artificial sequence
  Synthetic peptide
RWLSSRPLPPLPLPPRT

SEQ ID NO: 818 - protein, 20 aa, Artificial sequence
  Synthetic peptide
GSGSYDTLALPSLPLHPMSS

SEQ ID NO: 819 - protein, 20 aa, Artificial sequence
  Synthetic peptide
GSGSYDTRALPSLPLHPMSS

SEQ ID NO: 820 - protein, 20 aa, Artificial sequence
  Synthetic peptide
GSGSSGVTMYPKLPPHWSMA

SEQ ID NO: 821 - protein, 20 aa, Artificial sequence
  Synthetic peptide
GSGSSGVRMYPKLPPHWSMA

SEQ ID NO: 822 - protein, 20 aa, Artificial sequence
  Synthetic peptide
GSGSSSMRMVPTIPGSAKHG

SEQ ID NO: 823 - protein, 6 aa, Artificial sequence
  Synthetic peptide
RNRQKT

SEQ ID NO: 824 - protein, 4 aa, Artificial sequence
  Synthetic peptide
RNRQ

SEQ ID NO: 825 - protein, 5 aa, Artificial sequence
  Synthetic peptide
RNRQK

SEQ ID NO: 826 - protein, 5 aa, Artificial sequence
  Synthetic peptide
NRQKT

SEQ ID NO: 827 - protein, 4 aa, Artificial sequence
  Synthetic peptide
RQKT

SEQ ID NO: 828 - protein, 7 aa, Artificial sequence
  Synthetic peptide
RPLPPLP

SEQ ID NO: 829 - protein, 7 aa, Artificial sequence
  Synthetic peptide
RELPPLP

SEQ ID NO: 830 - protein, 7 aa, Artificial sequence
  Synthetic peptide
SPLPPLP

SEQ ID NO: 831 - protein, 7 aa, Artificial sequence
  Synthetic peptide
GPLPPLP

SEQ ID NO: 832 - protein, 7 aa, Artificial sequence
  Synthetic peptide
RPLPIPP

SEQ ID NO: 833 - protein, 7 aa, Artificial sequence
  Synthetic peptide
RPLPIPP

SEQ ID NO: 834 - protein, 7 aa, Artificial sequence
  Synthetic peptide
RRLPPTP

SEQ ID NO: 835 - protein, 7 aa, Artificial sequence
  Synthetic peptide
RQLPPTP

SEQ ID NO: 836 - protein, 7 aa, Artificial sequence
  Synthetic peptide
RPLPSRP

SEQ ID NO: 837 - protein, 7 aa, Artificial sequence
  Synthetic peptide
RPLPTRP

SEQ ID NO: 838 - protein, 7 aa, Artificial sequence
  Synthetic peptide
SRLPPLP

SEQ ID NO: 839 - protein, 7 aa, Artificial sequence
  Synthetic peptide
RALPSPP

SEQ ID NO: 840 - protein, 7 aa, Artificial sequence
  Synthetic peptide
RRLPRTP

SEQ ID NO: 841 - protein, 7 aa, Artificial sequence
  Synthetic peptide
RPVPPIT

SEQ ID NO: 842 - protein, 7 aa, Artificial sequence
  Synthetic peptide
ILAPPVP

SEQ ID NO: 843 - protein, 7 aa, Artificial sequence
  Synthetic peptide
RPLPMLP

SEQ ID NO: 844 - protein, 7 aa, Artificial sequence
  Synthetic peptide
RPLPILP

SEQ ID NO: 845 - protein, 7 aa, Artificial sequence
  Synthetic peptide
RPLPSLP

SEQ ID NO: 846 - protein, 7 aa, Artificial sequence
  Synthetic peptide
RPLPSLP

SEQ ID NO: 847 - protein, 7 aa, Artificial sequence
  Synthetic peptide
RPLPMIP

SEQ ID NO: 848 - protein, 7 aa, Artificial sequence
  Synthetic peptide
RPLPLIP

SEQ ID NO: 849 - protein, 7 aa, Artificial sequence
  Synthetic peptide
RPLPPTP

SEQ ID NO: 850 - protein, 7 aa, Artificial sequence
  Synthetic peptide
RSLPPLP

SEQ ID NO: 851 - protein, 7 aa, Artificial sequence
  Synthetic peptide
RPQPPPP

SEQ ID NO: 852 - protein, 7 aa, Artificial sequence
  Synthetic peptide
RQLPIPP

SEQ ID NO: 853 - protein, 12 aa, Artificial sequence
  Synthetic peptide
  Misc feature (1)..(3): Xaa=any amino acid
  Misc feature (11)..(11): Xaa=any amino acid
XXXRPLPPLPXP

SEQ ID NO: 854 - protein, 12 aa, Artificial sequence
  Synthetic peptide
  Misc feature (1)..(3): Xaa=any amino acid
  Misc feature (11)..(12): Xaa=any amino acid
XXXRPLPPIPXX

SEQ ID NO: 855 - protein, 12 aa, Artificial sequence
  Synthetic peptide
  Misc feature (1)..(3): Xaa=any amino acid
  Misc feature (11)..(12): Xaa=any amino acid
XXXRPLPPLPXX

SEQ ID NO: 856 - protein, 12 aa, Artificial sequence
  Synthetic peptide
  Misc feature (2)..(3): Xaa=any amino acid
  Misc feature (11)..(11): Xaa=any amino acid
RXXRPLPPLPXP

SEQ ID NO: 857 - protein, 12 aa, Artificial sequence
  Synthetic peptide
  Misc feature (2)..(3): Xaa=any amino acid
RXXRPLPPLPPP

SEQ ID NO: 858 - protein, 12 aa, Artificial sequence
  Synthetic peptide
  Misc feature (11)..(12): Xaa=any amino acid
PPPYPPPPIPXX

SEQ ID NO: 859 - protein, 12 aa, Artificial sequence
  Synthetic peptide
  Misc feature (11)..(12): Xaa=any amino acid
PPPYPPPPVPXX

SEQ ID NO: 860 - protein, 10 aa, Artificial sequence
  Synthetic peptide
  Misc feature (2)..(3): Xaa=any amino acid
  Misc feature (8)..(8): Xaa=any amino acid
  Misc feature (9)..(9): Xaa=Ile, Val, Leu, Ala or Pro
LXXRPLPXXP

SEQ ID NO: 861 - protein, 10 aa, Artificial sequence
  Synthetic peptide
  Misc feature (1)..(1): Xaa=Ile, Val, Leu, Ala, or Pro
  Misc feature (2)..(3): Xaa=any amino acid
  Misc feature (8)..(8): Xaa=any amino acid
XXXRPLPXLP

SEQ ID NO: 862 - protein, 10 aa, Artificial sequence
  Synthetic peptide
  Misc feature (3)..(3): Xaa=any amino acid
  Misc feature (4)..(4): Xaa=Phe, Tyr, or Trp
  Misc feature (5)..(5): Xaa=any amino acid
  Misc feature (9)..(9): Xaa=Ile, Val, Leu, Ala, or Pro
PPXXXPPPXP

SEQ ID NO: 863 - protein, 11 aa, Artificial sequence
  Synthetic peptide
  Misc feature (1)..(1): Xaa=His, Lys, or Arg
  Misc feature (4)..(4): Xaa=Ile, Val, Leu, Ala, or Pro
  Misc feature (6)..(6): Xaa=any amino acid
  Misc feature (9)..(9): Xaa=any amino acid
XPPXPXKPXWL

SEQ ID NO: 864 - protein, 11 aa, Artificial sequence
  Synthetic peptide
  Misc feature (3)..(3): Xaa=any amino acid
  Misc feature (4)..(4): Xaa=Ile, Val, Leu, Ala, or Pro
  Misc feature (6)..(6): Xaa=Ile, Val, Leu, Ala, or Pro
  Misc feature (8)..(8): Xaa=His, Lys, or Arg
  Misc feature (10)..(10): Xaa=any amino acid
RPXXPXRXSXP

SEQ ID NO: 865 - protein, 11 aa, Artificial sequence
  Synthetic peptide
  Misc feature (8)..(9): Xaa=any amino acid
PPVPPRPXXTL

SEQ ID NO: 866 - protein, 7 aa, Artificial sequence
  Synthetic peptide
  Misc feature (1)..(1): Xaa=Ile, Val, Leu, Ala, or Pro
  Misc feature (3)..(3): Xaa=Ile, Val, Leu, Ala, or Pro
  Misc feature (6)..(6): Xaa=Ile, Val, Leu, Ala, or Pro
XPXLPXK

SEQ ID NO: 867 - protein, 10 aa, Artificial sequence
  Synthetic peptide
  Misc feature (1)..(1): Xaa=His, Lys, or Arg
  Misc feature (2)..(2): Xaa=Phe, Tyr, or Trp
  Misc feature (4)..(4): Xaa=any amino acid
  Misc feature (8)..(8): Xaa=any amino acid
XXDXPLPXLP

SEQ ID NO: 868 - protein, 17 aa, Artificial sequence
  Synthetic peptide
  Misc feature (1)..(1): Xaa=Asp, Arg, Met, Pro, or Cys
  Misc feature (2)..(2): If residue 1 is Asp, Xaa=Arg; if residue 1 is Arg, Xaa=Met; if residue 1 is Met, Xaa=Pro; if residue 1 is Pro, Xaa=Cys; if residue 1 is Cys, Xaa=nothing
  Misc feature (3)..(3): If residue 1 is Asp, Xaa=Met; if residue 1 is Arg, Xaa=Pro; if residue 1 is Met, Xaa=Cys; if residue 1 is Pro or Cys, Xaa=nothing
  Misc feature (4)..(4): If residue 1 is Asp, Xaa=Pro; if residue 1 is Arg, Xaa=Cys; if residue 1 is Met, Pro, or Cys, Xaa=nothing
  Misc feature (5)..(5): If residue 1 is Asp, Xaa=Cys; if residue 1 is Arg, Met, Pro, or Cys, Xaa=nothing
  Misc feature (6)..(6): Xaa=Arg or Lys
  Misc feature (14)..(14): Xaa=Ser or Thr
  Misc feature (16)..(16): Xaa=Cys
  Misc feature (17)..(17): Xaa=Lys or nothing
XXXXXXNFFWKTFXSXX

SEQ ID NO: 869 - protein, 17 aa, Artificial sequence
  Synthetic peptide
DRMPCRNFFWKTFSSCK

SEQ ID NO: 870 - protein, 15 aa, Artificial sequence
  Synthetic peptide
MPCRNFFWKTFSSCK

SEQ ID NO: 871 - protein, 13 aa, Artificial sequence
  Synthetic peptide
CRNFFWKTFSSCK

SEQ ID NO: 872 - protein, 16 aa, Artificial sequence
  Synthetic peptide
DRMPCRNFFWKTFSSC

SEQ ID NO: 873 - protein, 14 aa, Artificial sequence
  Synthetic peptide
MPCRNFFWKTFSSC

SEQ ID NO: 874 - protein, 12 aa, Artificial sequence
  Synthetic peptide
CRNFFWKTFSSC

SEQ ID NO: 875 - protein, 16 aa, Artificial sequence
  Synthetic peptide
DRMPCKNFFWKTFSSC

SEQ ID NO: 876 - protein, 15 aa, Artificial sequence
  Synthetic peptide
MPCKNFFWKTFSSCK

SEQ ID NO: 877 - protein, 13 aa, Artificial sequence
  Synthetic peptide
CKNFFWKTFSSCK

SEQ ID NO: 878 - protein, 16 aa, Artificial sequence
  Synthetic peptide
DRMPCKNFFWKTFSSC

SEQ ID NO: 879 - protein, 14 aa, Artificial sequence
  Synthetic peptide
MPCKNFFWKTFSSC

SEQ ID NO: 880 - protein, 12 aa, Artificial sequence
  Synthetic peptide
CKNFFWKTFSSC

SEQ ID NO: 881 - protein, 17 aa, Artificial sequence
  Synthetic peptide
DRMPCRNFFWKTFTSCK

SEQ ID NO: 882 - protein, 15 aa, Artificial sequence
  Synthetic peptide
MPCRNFFWKTFTSCK

SEQ ID NO: 883 - protein, 13 aa, Artificial sequence
  Synthetic peptide
CRNFFWKTFTSCK

SEQ ID NO: 884 - protein, 16 aa, Artificial sequence
  Synthetic peptide
DRMPCRNFFWKTFTSC

SEQ ID NO: 885 - protein, 14 aa, Artificial sequence
  Synthetic peptide
MPCRNFFWKTFTSC

SEQ ID NO: 886 - protein, 12 aa, Artificial sequence
  Synthetic peptide
CRNFFWKTFTSC

SEQ ID NO: 887 - protein, 17 aa, Artificial sequence
  Synthetic peptide
DRMPCKNFFWKTFTSCK

SEQ ID NO: 888 - protein, 15 aa, Artificial sequence
  Synthetic peptide
MPCKNFFWKTFTSCK

SEQ ID NO: 889 - protein, 13 aa, Artificial sequence
  Synthetic peptide
CKNFFWKTFTSCK

SEQ ID NO: 890 - protein, 16 aa, Artificial sequence
  Synthetic peptide
DRMPCKNFFWKTFTSC

SEQ ID NO: 891 - protein, 14 aa, Artificial sequence
  Synthetic peptide
MPCKNFFWKTFTSC

SEQ ID NO: 892 - protein, 12 aa, Artificial sequence
  Synthetic peptide
CKNFFWKTFTSC

SEQ ID NO: 893 - protein, 17 aa, Artificial sequence
  Synthetic peptide
AEPMPHSLNFSQYLWYT

SEQ ID NO: 894 - protein, 17 aa, Artificial sequence
  Synthetic peptide
AEHTYSSLWDTYSPLAF

SEQ ID NO: 895 - protein, 17 aa, Artificial sequence
  Synthetic peptide
AELDLWMRHYPLSFSNR

SEQ ID NO: 896 - protein, 17 aa, Artificial sequence
  Synthetic peptide
AESSLWTRYAWPSMPSY

SEQ ID NO: 897 - protein, 17 aa, Artificial sequence
  Synthetic peptide
AEWHPGLSFGSYLWSKT

SEQ ID NO: 898 - protein, 17 aa, Artificial sequence
  Synthetic peptide
AEPALLNWSFFFNPGLH

SEQ ID NO: 899 - protein, 17 aa, Artificial sequence
  Synthetic peptide
AEWSFYNLHLPEPQTIF

SEQ ID NO: 900 - protein, 17 aa, Artificial sequence
  Synthetic peptide
AEPLDLWSLYSLPPLAM

SEQ ID NO: 901 - protein, 17 aa, Artificial sequence
  Synthetic peptide
AEPTLWQLYQFPLRLSG

SEQ ID NO: 902 - protein, 17 aa, Artificial sequence
  Synthetic peptide
AEISFSELMWLRSTPAF

SEQ ID NO: 903 - protein, 17 aa, Artificial sequence
  Synthetic peptide
AELSEADLWTTWFGMGS

SEQ ID NO: 904 - protein, 17 aa, Artificial sequence
  Synthetic peptide
AESSLWRIFSPSALMMS

SEQ ID NO: 905 - protein, 17 aa, Artificial sequence
  Synthetic peptide
AESLPTLTSILWGKESV

SEQ ID NO: 906 - protein, 17 aa, Artificial sequence
  Synthetic peptide
AETLFMDLWHDKHILLT

SEQ ID NO: 907 - protein, 17 aa, Artificial sequence
  Synthetic peptide
AEILNFPLWHEPLWSTE

SEQ ID NO: 908 - protein, 17 aa, Artificial sequence
  Synthetic peptide
AESQTGTLNTLFWNTLR

SEQ ID NO: 909 - protein, 17 aa, Artificial sequence
  Synthetic peptide
AEPVYQYELDSYLRSYY

SEQ ID NO: 910 - protein, 17 aa, Artificial sequence
  Synthetic peptide
AELDLSTFYDIQYLLRT

SEQ ID NO: 911 - protein, 17 aa, Artificial sequence
  Synthetic peptide
AEFFKLGPNGYVYLHSA

SEQ ID NO: 912 - protein, 11 aa, Artificial sequence
  Synthetic peptide
  Misc feature (4)..(6): Xaa=any amino acid
FKLXXXGYVYL

SEQ ID NO: 913 - protein, 17 aa, Artificial sequence
  Synthetic peptide
AESTYHHLSLGYMYTLN

SEQ ID NO: 914 - protein, 11 aa, Artificial sequence
  Synthetic peptide
  Misc feature (3)..(3): Xaa=any amino acid
  Misc feature (5)..(6): Xaa=any amino acid
YHXLXXGYMYT

SEQ ID NO: 915 - protein, 19 aa, Artificial sequence
  Synthetic peptide
VEPNCDIHVMWEWECFERL

SEQ ID NO: 916 - protein, 18 aa, Artificial sequence
  Synthetic peptide
GERWCFDGPLTWVCGEES

SEQ ID NO: 917 - protein, 20 aa, Artificial sequence
  Synthetic peptide
RGWVEICVADDNGMCVTEAQ

SEQ ID NO: 918 - protein, 19 aa, Artificial sequence
  Synthetic peptide
GWDECDVARMWEWECFAGV

SEQ ID NO: 919 - protein, 18 aa, Artificial sequence
  Synthetic peptide
GERWCFDGPRAWVCGWEI

SEQ ID NO: 920 - protein, 18 aa, Artificial sequence
  Synthetic peptide
EELWCFDGPRAWVCGYVK

SEQ ID NO: 921 - protein, 20 aa, Artificial sequence
  Synthetic peptide
RGWVEICAADDYGRCLTEAQ

SEQ ID NO: 922 - protein, 16 aa, Artificial sequence
  Synthetic peptide
RGWVEICESDVWGRCL

SEQ ID NO: 923 - protein, 16 aa, Artificial sequence
  Synthetic peptide
RGWVEICESDVWGRCL

SEQ ID NO: 924 - protein, 19 aa, Artificial sequence
  Synthetic peptide
GGNECDIARMWEWECFERL

SEQ ID NO: 925 - protein, 16 aa, Artificial sequence
  Synthetic peptide
RGWVEICAADDYGRCL

SEQ ID NO: 926 - protein, 10 aa, Artificial sequence
  Synthetic peptide
CTTHWGFTLC

SEQ ID NO: 927 - protein, 8 aa, Artificial sequence
  Synthetic peptide
  Misc feature (6)..(6): Xaa=any amino acid
CLRSGXGC

SEQ ID NO: 928 - protein, 10 aa, Artificial sequence
  Synthetic peptide
  Misc feature (2)..(3): Xaa=any amino acid
  Misc feature (8)..(9): Xaa=any amino acid
CXXHWGFXXC

SEQ ID NO: 929 - protein, 5 aa, Artificial sequence
  Synthetic peptide
  Misc feature (2)..(2): Xaa= any amino acid
  Misc feature (4)..(4): Xaa= any amino acid
CXPXC

SEQ ID NO: 930 - protein, 10 aa, Artificial sequence
  Synthetic peptide
CRRHWGFEFC

SEQ ID NO: 931 - protein, 10 aa, Artificial sequence
  Synthetic peptide
STTHWGFTLS

SEQ ID NO: 932 - protein, 10 aa, Artificial sequence
  Synthetic peptide
CSLHWGFWWC

SEQ ID NO: 933 - protein, 15 aa, Artificial sequence
  Synthetic peptide
GFVCSGIFAVGVGRC

SEQ ID NO: 934 - protein, 15 aa, Artificial sequence
  Synthetic peptide
APGVRLGCAVLGRYC

SEQ ID NO: 935 - protein, 6 aa, Artificial sequence
  Synthetic peptide
LLGRMK

SEQ ID NO: 936 - protein, 27 aa, Artificial sequence
  Synthetic peptide
ICVVQDWGHHRCTAGHMANLTSHASAI

SEQ ID NO: 937 - protein, 13 aa, Artificial sequence
  Synthetic peptide
ICVVQDWGHHRCT

SEQ ID NO: 938 - protein, 11 aa, Artificial sequence
  Synthetic peptide
CVVQDWGHHAC

SEQ ID NO: 939 - protein, 27 aa, Artificial sequence
  Synthetic peptide
STGGFDDVYDWARGVSSALTTTLVATR

SEQ ID NO: 940 - protein, 27 aa, Artificial sequence
  Synthetic peptide
STGGFDDVYDWARRVSSALTTTLVATR

SEQ ID NO: 941 - protein, 30 aa, Artificial sequence
  Synthetic peptide
SRGVNFSEWLYDMSAAMKEASNVFPSRRSR

SEQ ID NO: 942 - protein, 30 aa, Artificial sequence
  Synthetic peptide
SSQNWDMEAGVEDLTAAMLGLLSTIHSSSR

SEQ ID NO: 943 - protein, 31 aa, Artificial sequence
  Synthetic peptide
SSPSLYTQFLVNYESAATRIQDLLIASRPSR

SEQ ID NO: 944 - protein, 31 aa, Artificial sequence
  Synthetic peptide
SSTGWVDLLGALQRAADATRTSIPPSLQNSR

SEQ ID NO: 945 - protein, 18 aa, Artificial sequence
  Synthetic peptide
DVYTKKELIECARRVSEK

SEQ ID NO: 946 - protein, 22 aa, Artificial sequence
  Synthetic peptide
EKGSYYPGSGIAQFHIDYNNVS

SEQ ID NO: 947 - protein, 22 aa, Artificial sequence
  Synthetic peptide
SGIAQFHIDYNNVSSAEGWHVN

SEQ ID NO: 948 - protein, 34 aa, Artificial sequence
  Synthetic peptide
LVTVEKGSYYPGSGIAQFHIDYNNVSSAEGWHVN

SEQ ID NO: 949 - protein, 14 aa, Artificial sequence
  Synthetic peptide
SGIAQFHIDYNNVS

SEQ ID NO: 950 - protein, 6 aa, Artificial sequence
  Synthetic peptide
LLGRMK

SEQ ID NO: 951 - protein, 8 aa, Artificial sequence
  Synthetic peptide
ALLGRMKG

SEQ ID NO: 952 - protein, 6 aa, Artificial sequence
  Synthetic peptide
LDPAFR

SEQ ID NO: 953 - protein, 7 aa, Artificial sequence
  Synthetic peptide
  Misc feature (2)..(3): Xaa=any amino acid
CXXRGDC

SEQ ID NO: 954 - protein, 7 aa, Artificial sequence
  Synthetic peptide
RPLPPLP

SEQ ID NO: 955 - protein, 6 aa, Artificial sequence
  Synthetic peptide
PPVPPR

SEQ ID NO: 956 - protein, 11 aa, Artificial sequence
  Synthetic peptide
  Misc feature (1)..(1): Xaa= any amino acid
  Misc feature (3)..(3): Xaa= any amino acid
  Misc feature (5)..(5): Xaa= any amino acid
  Misc feature (7)..(8): Xaa= any amino acid
  Misc feature (10)..(11): Xaa= any amino acid
XFXDXWXXLXX

SEQ ID NO: 957 - protein, 20 aa, Artificial sequence
  Synthetic peptide
KACRRLFGPVDSEQLSRDCD

SEQ ID NO: 958 - protein, 20 aa, Artificial sequence
  Synthetic peptide
RERWNFDFVTETPLEGDFAW

SEQ ID NO: 959 - protein, 20 aa, Artificial sequence
  Synthetic peptide
KRRQTSMTDFYHSKRRLIFS

SEQ ID NO: 960 - protein, 20 aa, Artificial sequence
  Synthetic peptide
TSMTDFYHSKRRLIFSKRKP

SEQ ID NO: 961 - protein, 5 aa, Artificial sequence
  Synthetic peptide
RRLIF

SEQ ID NO: 962 - protein, 36 aa, Artificial sequence [sequence omitted]

SEQ ID NO: 963 - protein, 24 aa, Artificial sequence
  Synthetic peptide
KRRLIFSKRQIKIWFQNRRMKWKK

SEQ ID NO: 964 - protein, 24 aa, Artificial sequence
  Synthetic peptide
NQGRHFCGALIHARFVMTAASCFQ

SEQ ID NO: 965 - protein, 20 aa, Artificial sequence
  Synthetic peptide
RHFCGGALIHARFVMTAASC

SEQ ID NO: 966 - protein, 27 aa, Artificial sequence
  Synthetic peptide
GTRCQVAGWGSQRSGGRLSRFPRFVNV

SEQ ID NO: 967 - protein, 15 aa, Artificial sequence
  Synthetic peptide
WHWRHRIPLQLAAGR

SEQ ID NO: 968 - protein, 6 aa, Artificial sequence
  Synthetic peptide
LKTPRV

SEQ ID NO: 969 - protein, 8 aa, Artificial sequence
  Synthetic peptid
NTLKTPRV

SEQ ID NO: 970 - protein, 11 aa, Artificial sequence
  Synthetic peptide
NTLKTPRVGGC

SEQ ID NO: 971 - protein, 6 aa, Artificial sequence
  Synthetic peptide
KDKATF

SEQ ID NO: 972 - protein, 10 aa, Artificial sequence
  Synthetic peptide
KDKATFGCHD

SEQ ID NO: 973 - protein, 12 aa, Artificial sequence
  Synthetic peptide
KDKATFGCHDGC

SEQ ID NO: 974 - protein, 6 aa, Artificial sequence
  Synthetic peptide
TLRVYK

SEQ ID NO: 975 - protein, 9 aa, Artificial sequence
  Synthetic peptide
ATLRVYKGG

SEQ ID NO: 976 - protein, 10 aa, Artificial sequence
  Synthetic peptide
CATLRVYKGG

SEQ ID NO: 977 - protein, 14 aa, Artificial sequence
  Synthetic peptide
INLKALAALAKKIL

SEQ ID NO: 978 - protein, 12 aa, Artificial sequence
  Synthetic peptide
GWTLNSAGYLLG

SEQ ID NO: 979 - protein, 27 aa, Artificial sequence
  Synthetic peptide
GWTLNSAGYLLGKINLKALAALAKKIL

SEQ ID NO: 980 - protein, 7 aa, Artificial sequence
  Synthetic peptide
CVHAYRS

SEQ ID NO: 981 - protein, 7 aa, Artificial sequence
  Synthetic peptide
CVHAYRA

SEQ ID NO: 982 - protein, 7 aa, Artificial sequence
  Synthetic peptide
CVHAPRS

SEQ ID NO: 983 - protein, 7 aa, Artificial sequence
  Synthetic peptide
CVHAPRA

SEQ ID NO: 984 - protein, 7 aa, Artificial sequence
  Synthetic peptide
CVHSYRS

SEQ ID NO: 985 - protein, 7 aa, Artificial sequence
  Synthetic peptide
CVHSYRA

SEQ ID NO: 986 - protein, 7 aa, Artificial sequence
  Synthetic peptide
CVHSPRS

SEQ ID NO: 987 - protein, 7 aa, Artificial sequence
  Synthetic peptide
CVHSPRA

SEQ ID NO: 988 - protein, 7 aa, Artificial sequence
  Synthetic peptide
CVHTYRS

SEQ ID NO: 989 - protein, 7 aa, Artificial sequence
  Synthetic peptide
CVHTYRA

SEQ ID NO: 990 - protein, 7 aa, Artificial sequence
  Synthetic peptide
CVHTPRS

SEQ ID NO: 991 - protein, 7 aa, Artificial sequence
  Synthetic peptide
CVHTPRA

SEQ ID NO: 992 - protein, 6 aa, Artificial sequence
  Synthetic peptide
HWAWFK

SEQ ID NO: 993 - protein, 32 aa, Artificial sequence
  Synthetic peptide
IEGPTLRQWLAARAGPNGIEGPTLRQWLAARA

SEQ ID NO: 994 - protein, 36 aa, Artificial sequence
  Synthetic peptide
IEGPTLRQCLAARAGGGGGGGGIEGPTLRQCLAARA

SEQ ID NO: 995 - protein, 36 aa, Artificial sequence; identical to SEQ ID NO: 994
  Synthetic peptide

SEQ ID NO: 996 - protein, 36 aa, Artificial sequence
  Synthetic peptide
IEGPTLRQALAARAGGGGGGGGIEGPTLRQALAARA

SEQ ID NO: 997 - protein, 36 aa, Artificial sequence
  Synthetic peptide
IEGPTLRQWLAARAGGGKGGGGIEGPTLRQWLAARA

SEQ ID NO: 998 - protein, 36 aa, Artificial sequence; identical to SEQ ID NO: 997
  Synthetic peptide

SEQ ID NO: 999 - protein, 36 aa, Artificial sequence
  Synthetic peptide
IEGPTLRQWLAARAGGGCGGGGIEGPTLRQWLAARA

SEQ ID NO: 1000 - protein, 36 aa, Artificial sequence; identical to SEQ ID NO: 997
  Synthetic peptide

SEQ ID NO: 1001 - protein, 36 aa, Artificial sequence; identical to SEQ ID NO: 999
  Synthetic peptide

SEQ ID NO: 1002 - protein, 36 aa, Artificial sequence
  Synthetic peptide
IEGPTLRQWLAARAGGGNGSGGIEGPTLRQWLAARA

SEQ ID NO: 1003 - protein, 36 aa, Artificial sequence; identical to SEQ ID NO: 999
  Synthetic peptide

SEQ ID NO: 1004 - protein, 36 aa, Artificial sequence
  Synthetic peptide
IEGPTLRQWLAARAGGGGGGGGIEGPTLRQWLAARA

SEQ ID NO: 1005 - protein, 32 aa, Artificial sequence; identical to SEQ ID NO: 993
  Synthetic peptide

SEQ ID NO: 1006 - protein, 32 aa, Artificial sequence; identical to SEQ ID NO: 993
  Synthetic peptide

SEQ ID NO: 1007 - protein, 36 aa, Artificial sequence; identical to SEQ ID NO: 1004
  Synthetic peptide

SEQ ID NO: 1008 - protein, 34 aa, Artificial sequence
  Synthetic peptide
GGIEGPTLRQWLAARAGPNGIEGPTLRQWLAARA

SEQ ID NO: 1009 - protein, 36 aa, Artificial sequence; identical to SEQ ID NO: 1004
  Synthetic peptide

SEQ ID NO: 1010 - protein, 36 aa, Artificial sequence; identical to SEQ ID NO: 994
  Synthetic peptide

SEQ ID NO: 1011 - protein, 36 aa, Artificial sequence; identical to SEQ ID NO: 994
  Synthetic peptide

SEQ ID NO: 1012 - protein, 36 aa, Artificial sequence; identical to SEQ ID NO: 996
  Synthetic peptide

SEQ ID NO: 1013 - protein, 36 aa, Artificial sequence; identical to SEQ ID NO: 997
  Synthetic peptide

SEQ ID NO: 1014 - protein, 36 aa, Artificial sequence; identical to SEQ ID NO: 999
  Synthetic peptide

SEQ ID NO: 1015 - protein, 36 aa, Artificial sequence; identical to SEQ ID NO: 1002
  Synthetic peptide

SEQ ID NO: 1016 - protein, 36 aa, Artificial sequence; identical to SEQ ID NO: 999
  Synthetic peptide

SEQ ID NO: 1017 - protein, 41 aa, Artificial sequence
  Synthetic peptide
GGGGGIEGPTLRQWLAARAGGGGGGGGIEGPTLRQWLAARA

SEQ ID NO: 1018 - protein, 8 aa, Artificial sequence
  Synthetic peptide
GGGKGGGG

SEQ ID NO: 1019 - protein, 8 aa, Artificial sequence
  Synthetic peptide
GGGNGSGG

SEQ ID NO: 1020 - protein, 8 aa, Artificial sequence
  Synthetic peptide
GGGCGGGG

SEQ ID NO: 1021 - protein, 5 aa, Artificial sequence
  Synthetic peptide
GPNGG

SEQ ID NO: 1022 - DNA, 29 bp, Artificial Sequence
  Synthetic primer
ccgggtaaaggtggaggtggtggtatcga

SEQ ID NO: 1023 - DNA, 18 bp, Artificial sequence
  Synthetic primer
ctagttattgctcagcgg

SEQ ID NO: 1024 - DNA, 29 bp, Artificial Sequence
  Synthetic primer
ccgggtaaaggtggaggtggtggtatcga

SEQ ID NO: 1025 - DNA, 30 bp, Artificial sequence
  Synthetic primer
ccacctccacctttacccggagagtgggag

SEQ ID NO: 1026 - DNA, 25 bp, Artificial sequence
  Synthetic primer
cgtacaggtttacgcaagaaaatgg

SEQ ID NO: 1027 - DNA, 30 bp, Artificial sequence; identical to SEQ ID NO: 1025
  Synthetic primer

SEQ ID NO: 1028 - DNA, 25 bp, Artificial sequence
  Synthetic primer
cgtacaggtttacgcaagaaaatgg

SEQ ID NO: 1029 - DNA, 18 bp, Artificial sequence
  Synthetic primer
ctagttattgctcagcgg

SEQ ID NO: 1030 - DNA, 25 bp, Artificial sequence
  Synthetic peptide
cgtacaggtttacgcaagaaaatgg

SEQ ID NO: 1031 - DNA, 18 bp, Artificial sequence
  Synthetic primer
ctagttattgctcagcgg

SEQ ID NO: 1032 - DNA, 895 bp, Artificial sequence
  Synthetic polynucleotide
gatttgattctagatttgttttaactaattaaaggaggaataacatatggtcgacggttgtaagccatgcatttgtacagtcccagaagtatcatctgtcttcatcttccccccaaagcccaaggatgtgctcaccattactctgactcctaaggtcacgtgtgttgtggtagacatcagcaaggatgatcccgaggtccagttcagctggtttgtagatgatgtggaggtgcacacagctcagacgcaaccccgggaggagcagttcaacagcactttccgctcagtcagtgaacttcccatcatgcaccaggactggctcaatggcaaggagttcaaatgcagggtcaacagtgcagctttccctgcccccatcgagaaaaccatctccaaaaccaaaggcagaccgaaggctccacaggtgtacaccattccacctcccaaggagcagatggccaaggataaagtcagtctgacctgcatgataacagacttcttccctgaagacattactgtggagtggcagtggaatgggcagccagcggagaactacaagaacactcagcccatcatggacacagatggctcttacttcgtctacagcaagctcaatgtgcagaagagcaactgggaggcaggaaatactttcacctgctctgtgttacatgagggcctgcacaaccaccatactgagaagagcctctcccactctccgggtaaaggtggaggtggtggtatcgaaggtccgactctgcgtcagtggctggctgctcgtgctggtggtggaggtggcggcggaggtattgagggcccaacccttcgccaatggcttgcagcacgcgcataatctcgaggatccgcggaaagaagaagaagaagaagaaagcccgaaagg

SEQ ID NO: 1033 - protein, 266 aa, Artificial sequence
  Synthetic peptide
MVDGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGKGGGGGIEGPTLRQWLAARAGGGGGGGGIEGPTLRQWLAARA

SEQ ID NO: 1034 - DNA, 895 bp, Artificial sequence; identical to SEQ ID NO: 1032
  Synthetic polynucleotide

SEQ ID NO: 1035 - protein, 266 aa, Artificial sequence; identical to SEQ ID NO: 1033
  Synthetic peptide

SEQ ID NO: 1036 - protein, 14 aa, Artificial sequence
  Synthetic peptide
KDKCKMWHWMCKPP

SEQ ID NO: 1037 - protein, 14 aa, Artificial sequence
  Synthetic peptide
KDLCAMWHWMCKPP

SEQ ID NO: 1038 - protein, 14 aa, Artificial sequence
  Synthetic peptide
KDLCKMWKWMCKPP

SEQ ID NO: 1039 - protein, 14 aa, Artificial sequence
  Synthetic peptide
KDLCKMWHWMCKPK

SEQ ID NO: 1040 - protein, 14 aa, Artificial sequence
  Synthetic peptide
WYPCYEFHFWCYDL

SEQ ID NO: 1041 - protein, 14 aa, Artificial sequence
  Synthetic peptide
WYPCYEGHFWCYDL

SEQ ID NO: 1042 - protein, 14 aa, Artificial sequence
  Synthetic peptide
IFGCKWWDVQCYQF

SEQ ID NO: 1043 - protein, 14 aa, Artificial sequence
  Synthetic peptide
IFGCKWWDVDCYQF

SEQ ID NO: 1044 - protein, 14 aa, Artificial sequence
  Synthetic peptide
ADWCVSPNWFCMVM

SEQ ID NO: 1045 - protein, 14 aa, Artificial sequence
  Synthetic peptide
HKFCPWWALFCWDF

SEQ ID NO: 1046 - protein, 14 aa, Artificial sequence
  Synthetic peptide
KDLCKMWHWMCKPP

SEQ ID NO: 1047 - protein, 14 aa, Artificial sequence
  Synthetic peptide
IDKCAIWGWMCPPL

SEQ ID NO: 1048 - protein, 14 aa, Artificial sequence
  Synthetic peptide
WYPCGEFGMWCLNV

SEQ ID NO: 1049 - protein, 11 aa, Artificial sequence
  Synthetic peptide
WFTCLWNCDNE

SEQ ID NO: 1050 - protein, 14 aa, Artificial sequence
  Synthetic peptide
HTPCPWFAPLCVEW

SEQ ID NO: 1051 - protein, 14 aa, Artificial sequence
  Synthetic peptide
KEWCWRWKWMCKPE

SEQ ID NO: 1052 - protein, 14 aa, Artificial sequence
  Synthetic peptide
FETCPSWAYFCLDI

SEQ ID NO: 1053 - protein, 14 aa, Artificial sequence
  Synthetic peptide
AYKCEANDWGCWWL

SEQ ID NO: 1054 - protein, 14 aa, Artificial sequence
  Synthetic peptide
NSWCEDQWHRCWWL

SEQ ID NO: 1055 - protein, 14 aa, Artificial sequence
  Synthetic peptide
WSACYAGHFWCYDL

SEQ ID NO: 1056 - protein, 14 aa, Artificial sequence
  Synthetic peptide
ANWCVSPNWFCMVM

SEQ ID NO: 1057 - protein, 14 aa, Artificial sequence
  Synthetic peptide
WTECYQQEFWCWNL

SEQ ID NO: 1058 - protein, 14 aa, Artificial sequence
  Synthetic peptide
ENTCERWKWMCPPK

SEQ ID NO: 1059 - protein, 14 aa, Artificial sequence
  Synthetic peptide
WLPCHQEGFWCMNF

SEQ ID NO: 1060 - protein, 14 aa, Artificial sequence
  Synthetic peptide
STMCSQWHWMCNPF

SEQ ID NO: 1061 - protein, 14 aa, Artificial sequence
  Synthetic peptide
IFGCHWWDVDCYQF

SEQ ID NO: 1062 - protein, 14 aa, Artificial sequence
  Synthetic peptide
IYGCKWWDIQCYDI

SEQ ID NO: 1063 - protein, 14 aa, Artificial sequence
  Synthetic peptide
PDWCIDPDWWCKFW

SEQ ID NO: 1064 - protein, 14 aa, Artificial sequence
  Synthetic peptide
QGHCTRWPWMCPPY

SEQ ID NO: 1065 - protein, 14 aa, Artificial sequence
  Synthetic peptide
WQECYREGFWCLQT

SEQ ID NO: 1066 - protein, 14 aa, Artificial sequence
  Synthetic peptide
WFDCYGPGFKCWSP

SEQ ID NO: 1067 - protein, 14 aa, Artificial sequence
  Synthetic peptide
GVRCPKGHLWCLYP

SEQ ID NO: 1068 - protein, 14 aa, Artificial sequence
  Synthetic peptide
HWACGYWPWSCKWV

SEQ ID NO: 1069 - protein, 14 aa, Artificial sequence
  Synthetic peptide
GPACHSPWWWCVFG

SEQ ID NO: 1070 - protein, 14 aa, Artificial sequence
  Synthetic peptide
TTWCISPMWFCSQQ

SEQ ID NO: 1071 - protein, 14 aa, Artificial sequence
  Synthetic peptide
HKFCPPWAIFCWDF

SEQ ID NO: 1072 - protein, 14 aa, Artificial sequence
  Synthetic peptide
PDWCVSPRWYCNMW

SEQ ID NO: 1073 - protein, 14 aa, Artificial sequence
  Synthetic peptide
VWKCHWFGMDCEPT

SEQ ID NO: 1074 - protein, 14 aa, Artificial sequence
  Synthetic peptide
KKHCQIWTWMCAPK

SEQ ID NO: 1075 - protein, 14 aa, Artificial sequence
  Synthetic peptide
WFQCGSTLFWCYNL

SEQ ID NO: 1076 - protein, 14 aa, Artificial sequence
  Synthetic peptide
WSPCYDHYFYCYTI

SEQ ID NO: 1077 - protein, 14 aa, Artificial sequence
  Synthetic peptide
SWMCGFFKEVCMWV

SEQ ID NO: 1078 - protein, 14 aa, Artificial sequence
  Synthetic peptide
EMLCMIHPVFCNPH

SEQ ID NO: 1079 - protein, 14 aa, Artificial sequence
  Synthetic peptide
LKTCNLWPWMCPPL

SEQ ID NO: 1080 - protein, 14 aa, Artificial sequence
  Synthetic peptide
VVGCKWYEAWCYNK

SEQ ID NO: 1081 - protein, 14 aa, Artificial sequence
  Synthetic peptide
PIHCTQWAWMCPPT

SEQ ID NO: 1082 - protein, 14 aa, Artificial sequence
  Synthetic peptide
DSNCPWYFLSCVIF

SEQ ID NO: 1083 - protein, 14 aa, Artificial sequence
  Synthetic peptide
HIWCNLAMMKCVEM

SEQ ID NO: 1084 - protein, 14 aa, Artificial sequence
  Synthetic peptide
NLQCIYFLGKCIYF

SEQ ID NO: 1085 - protein, 14 aa, Artificial sequence
  Synthetic peptide
AWRCMWFSDVCTPG

SEQ ID NO: 1086 - protein, 14 aa, Artificial sequence
  Synthetic peptide
WFRCFLDADWCTSV

SEQ ID NO: 1087 - protein, 14 aa, Artificial sequence
  Synthetic peptide
EKICQMWSWMCAPP

SEQ ID NO: 1088 - protein, 14 aa, Artificial sequence
  Synthetic peptide
WFYCHLNKSECTEP

SEQ ID NO: 1089 - protein, 14 aa, Artificial sequence
  Synthetic peptide
FWRCAIGIDKCKRV

SEQ ID NO: 1090 - protein, 14 aa, Artificial sequence
  Synthetic peptide
NLGCKWYEVWCFTY

SEQ ID NO: 1091 - protein, 14 aa, Artificial sequence
  Synthetic peptide
IDLCNMWDGMCYPP

SEQ ID NO: 1092 - protein, 14 aa, Artificial sequence
  Synthetic peptide
EMPCNIWGWMCPPV

SEQ ID NO: 1093 - protein, 18 aa, Artificial sequence
  Synthetic peptide
WFRCVLTGIVDWSECFGL

SEQ ID NO: 1094 - protein, 18 aa, Artificial sequence
  Synthetic peptide
GFSCTFGLDEFYVDCSPF

SEQ ID NO: 1095 - protein, 18 aa, Artificial sequence
  Synthetic peptide
LPWCHDQVNADWGFCMLW

SEQ ID NO: 1096 - protein, 18 aa, Artificial sequence
  Synthetic peptide
YPTCSEKFWIYGQTCVLW

SEQ ID NO: 1097 - protein, 18 aa, Artificial sequence
  Synthetic peptide
LGPCPIHHGPWPQYCVYW

SEQ ID NO: 1098 - protein, 18 aa, Artificial sequence
  Synthetic peptide
PFPCETHQISWLGHCLSF

SEQ ID NO: 1099 - protein, 18 aa, Artificial sequence
  Synthetic peptide
HWGCEDLMWSWHPLCRRP

SEQ ID NO: 1100 - protein, 18 aa, Artificial sequence
  Synthetic peptide
LPLCDADMMPTIGFCVAY

SEQ ID NO: 1101 - protein, 18 aa, Artificial sequence
  Synthetic peptide
SHWCETTFWMNYAKCVHA

SEQ ID NO: 1102 - protein, 18 aa, Artificial sequence
  Synthetic peptide
LPKCTHVPFDQGGFCLWY

SEQ ID NO: 1103 - protein, 18 aa, Artificial sequence
  Synthetic peptide
FSSCWSPVSRQDMFCVFY

SEQ ID NO: 1104 - protein, 17 aa, Artificial sequence
  Synthetic peptide
SHKCEYSGWLQPLCYRP

SEQ ID NO: 1105 - protein, 18 aa, Artificial sequence
  Synthetic peptide
PWWCQDNYVQHMLHCDSP

SEQ ID NO: 1106 - protein, 18 aa, Artificial sequence
  Synthetic peptide
WFRCMLMNSFDAFQCVSY

SEQ ID NO: 1107 - protein, 18 aa, Artificial sequence
  Synthetic peptide
PDACRDQPWYMFMGCMLG

SEQ ID NO: 1108 - protein, 14 aa, Artificial sequence
  Synthetic peptide
FLACFVEFELCFDS

SEQ ID NO: 1109 - protein, 18 aa, Artificial sequence
  Synthetic peptide
SAYCIITESDPYVLCVPL

SEQ ID NO: 1110 - protein, 18 aa, Artificial sequence
  Synthetic peptide
PSICESYSTMWLPMCQHN

SEQ ID NO: 1111 - protein, 18 aa, Artificial sequence
  Synthetic peptide
WLDCHDDSWAWTKMCRSH

SEQ ID NO: 1112 - protein, 18 aa, Artificial sequence
  Synthetic peptide
YLNCVMMNTSPFVECVFN

SEQ ID NO: 1113 - protein, 18 aa, Artificial sequence
  Synthetic peptide
YPWCDGFMIQQGITCMFY

SEQ ID NO: 1114 - protein, 18 aa, Artificial sequence
  Synthetic peptide
FDYCTWLNGFKDWKCWSR

SEQ ID NO: 1115 - protein, 18 aa, Artificial sequence
  Synthetic peptide
LPLCNLKEISHVQACVLF

SEQ ID NO: 1116 - protein, 18 aa, Artificial sequence
  Synthetic peptide
SPECAFARWLGIEQCQRD

SEQ ID NO: 1117 - protein, 18 aa, Artificial sequence
  Synthetic peptide
YPQCFNLHLLEWTECDWF

SEQ ID NO: 1118 - protein, 18 aa, Artificial sequence
  Synthetic peptide
RWRCEIYDSEFLPKCWFF

SEQ ID NO: 1119 - protein, 14 aa, Artificial sequence
  Synthetic peptide
LVGCDNVWHRCKLF

SEQ ID NO: 1120 - protein, 18 aa, Artificial sequence
  Synthetic peptide
AGWCHVWGEMFGMGCSAL

SEQ ID NO: 1121 - protein, 18 aa, Artificial sequence
  Synthetic peptide
HHECEWMARWMSLDCVGL

SEQ ID NO: 1122 - protein, 18 aa, Artificial sequence
  Synthetic peptide
FPMCGIAGMKDFDFCVWY

SEQ ID NO: 1123 - protein, 18 aa, Artificial sequence
  Synthetic peptide
RDDCTFWPEWLWKLCERP

SEQ ID NO: 1124 - protein, 18 aa, Artificial sequence
  Synthetic peptide
YNFCSYLFGVSKEACQLP

SEQ ID NO: 1125 - protein, 18 aa, Artificial sequence
  Synthetic peptide
AHWCEQGPWRYGNICMAY

SEQ ID NO: 1126 - protein, 18 aa, Artificial sequence
  Synthetic peptide
NLVCGKISAWGDEACARA

SEQ ID NO: 1127 - protein, 18 aa, Artificial sequence
  Synthetic peptide
HNVCTIMGPSMKWFCWND

SEQ ID NO: 1128 - protein, 18 aa, Artificial sequence
  Synthetic peptide
NDLCAMWGWRNTIWCQNS

SEQ ID NO: 1129 - protein, 18 aa, Artificial sequence
  Synthetic peptide
PPFCQNDNDMLQSLCKLL

SEQ ID NO: 1130 - protein, 18 aa, Artificial sequence
  Synthetic peptide
WYDCNVPNELLSGLCRLF

SEQ ID NO: 1131 - protein, 18 aa, Artificial sequence
  Synthetic peptide
YGDCDQNHWMWPFTCLSL

SEQ ID NO: 1132 - protein, 18 aa, Artificial sequence
  Synthetic peptide
GWMCHFDLHDWGATCQPD

SEQ ID NO: 1133 - protein, 18 aa, Artificial sequence
  Synthetic peptide
YFHCMFGGHEFEVHCESF

SEQ ID NO: 1134 - protein, 12 aa, Artificial sequence
  Synthetic peptide
AYWCWHGQCVRF

SEQ ID NO: 1135 - protein, 19 aa, Artificial sequence
  Synthetic peptide
SEHWTFTDWDGNEWWVRPF

SEQ ID NO: 1136 - protein, 20 aa, Artificial sequence
  Synthetic peptide
MEMLDSLFELLKDMVPISKA

SEQ ID NO: 1137 - protein, 19 aa, Artificial sequence
  Synthetic peptide
SPPEEALMEWLGWQYGKFT

SEQ ID NO: 1138 - protein, 20 aa, Artificial sequence
  Synthetic peptide
SPENLLNDLYILMTKQEWYG

SEQ ID NO: 1139 - protein, 20 aa, Artificial sequence
  Synthetic peptide
FHWEEGIPFHVVTPYSYDRM

SEQ ID NO: 1140 - protein, 19 aa, Artificial sequence
  Synthetic peptide
KRLLEQFMNDLAELVSGHS

SEQ ID NO: 1141 - protein, 20 aa, Artificial sequence
  Synthetic peptide
DTRDALFQEFYEFVRSRLVI

SEQ ID NO: 1142 - protein, 20 aa, Artificial sequence
  Synthetic peptide
RMSAAPRPLTYRDIMDQYWH

SEQ ID NO: 1143 - protein, 20 aa, Artificial sequence
  Synthetic peptide
NDKAHFFEMFMFDVHNFVES

SEQ ID NO: 1144 - protein, 20 aa, Artificial sequence
  Synthetic peptide
QTQAQKIDGLWELLQSIRNQ

SEQ ID NO: 1145 - protein, 18 aa, Artificial sequence
  Synthetic peptide
MLSEFEEFLGNLVHRQEA

SEQ ID NO: 1146 - protein, 20 aa, Artificial sequence
  Synthetic peptide
YTPKMGSEWTSFWHNRIHYL

SEQ ID NO: 1147 - protein, 20 aa, Artificial sequence
  Synthetic peptide
LNDTLLRELKMVLNSLSDMK

SEQ ID NO: 1148 - protein, 20 aa, Artificial sequence
  Synthetic peptide
FDVERDLMRWLEGFMQSAAT

SEQ ID NO: 1149 - protein, 20 aa, Artificial sequence
  Synthetic peptide
HHGWNYLRKGSAPQWFEAWV

SEQ ID NO: 1150 - protein, 20 aa, Artificial sequence
  Synthetic peptide
VESLHQLQMWLDQKLASGPH

SEQ ID NO: 1151 - protein, 18 aa, Artificial sequence
  Synthetic peptide
RATLLKDFWQLVEGYGDN

SEQ ID NO: 1152 - protein, 16 aa, Artificial sequence
  Synthetic peptide
EELLREFYRFVSAFDY

SEQ ID NO: 1153 - protein, 20 aa, Artificial sequence
  Synthetic peptide
GLLDEFSHFIAEQFYQMPGG

SEQ ID NO: 1154 - protein, 20 aa, Artificial sequence
  Synthetic peptide
YREMSMLEGLLDVLERLQHY

SEQ ID NO: 1155 - protein, 20 aa, Artificial sequence
  Synthetic peptide
HNSSQMLLSELIMLVGSMMQ

SEQ ID NO: 1156 - protein, 20 aa, Artificial sequence
  Synthetic peptide
WREHFLNSDYIRDKLIAIDG

SEQ ID NO: 1157 - protein, 19 aa, Artificial sequence
  Synthetic peptide
QFPFYVFDDLPAQLEYWIA

SEQ ID NO: 1158 - protein, 20 aa, Artificial sequence
  Synthetic peptide
EFFHWLHNHRSEVNHWLDMN

SEQ ID NO: 1159 - protein, 19 aa, Artificial sequence
  Synthetic peptide
EALFQNFFRDVLTLSEREY

SEQ ID NO: 1160 - protein, 20 aa, Artificial sequence
  Synthetic peptide
QYWEQQWMTYFRENGLHVQY

SEQ ID NO: 1161 - protein, 20 aa, Artificial sequence
  Synthetic peptide
NQRMMLEDLWRIMTPMFGRS

SEQ ID NO: 1162 - protein, 20 aa, Artificial sequence
  Synthetic peptide
FLDELKAELSRHYALDDLDE

SEQ ID NO: 1163 - protein, 20 aa, Artificial sequence
  Synthetic peptide
GKLIEGLLNELMQLETFMPD

SEQ ID NO: 1164 - protein, 15 aa, Artificial sequence
  Synthetic peptide
ILLLDEYKKDWKSWF

SEQ ID NO: 1165 - protein, 50 aa, Artificial sequence
  Synthetic peptide
QGHCTRWPWMCPPYGSGSATGGSGSTASSGSGSATGQGHCTRWPWMCPPY

SEQ ID NO: 1166 - protein, 43 aa, Artificial sequence
  Synthetic peptide
WYPCYEGHFWCYDLGSGSTASSGSGSATGWYPCYEGHFWCYDL

SEQ ID NO: 1167 - protein, 50 aa, Artificial sequence
  Synthetic peptide
HTPCPWFAPLCVEWGSGSATGGSGSTASSGSGSATGHTPCPWFAPLCVEW

SEQ ID NO: 1168 - protein, 50 aa, Artificial sequence
  Synthetic peptide
PDWCIDPDWWCKFWGSGSATGGSGSTASSGSGSATGPDWCIDPDWWCKFW

SEQ ID NO: 1169 - protein, 50 aa, Artificial sequence
  Synthetic peptide
ANWCVSPNWFCMVMGSGSATGGSGSTASSGSGSATGANWCVSPNWFCMVM

SEQ ID NO: 1170 - protein, 50 aa, Artificial sequence; identical to SEQ ID NO: 1168
  Synthetic peptide

SEQ ID NO: 1171 - protein, 50 aa, Artificial sequence
  Synthetic peptide
HWACGYWPWSCKWVGSGSATGGSGSTASSGSGSATGHWACGYWPWSCKWV

SEQ ID NO: 1172 - protein, 50 aa, Artificial sequence
  Synthetic peptide
KKHCQIWTWMCAPKGSGSATGGSGSTASSGSGSATGQGHCTRWPWMCPPY

SEQ ID NO: 1173 - protein, 50 aa, Artificial sequence
  Synthetic peptide
QGHCTRWPWMCPPYGSGSATGGSGSTASSGSGSATGKKHCQIWTWMCAPK

SEQ ID NO: 1174 - protein, 50 aa, Artificial sequence; identical to SEQ ID NO: 1172
  Synthetic peptide

SEQ ID NO: 1175 - protein, 36 aa, Artificial sequence
  Synthetic peptide
KKHCQIWTWMCAPKGGGGGGGGQGHCTRWPWMCPPY

SEQ ID NO: 1176 - protein, 34 aa, Artificial sequence
  Synthetic peptide
QGHCTRWPWMCPPYGGGGGGKKHCQIWTWMCAPK

SEQ ID NO: 1177 - protein, 20 aa, Artificial sequence
  Synthetic peptide
VALHGQCTRWPWMCPPQREG

SEQ ID NO: 1178 - protein, 20 aa, Artificial sequence
  Synthetic peptide
YPEQGLCTRWPWMCPPQTLA

SEQ ID NO: 1179 - protein, 20 aa, Artificial sequence
  Synthetic peptide
GLNQGHCTRWPWMCPPQDSN

SEQ ID NO: 1180 - protein, 20 aa, Artificial sequence
  Synthetic peptide
MITQGQCTRWPWMCPPQPSG

SEQ ID NO: 1181 - protein, 20 aa, Artificial sequence
  Synthetic peptide
AGAQEHCTRWPWMCAPNDWI

SEQ ID NO: 1182 - protein, 20 aa, Artificial sequence
  Synthetic peptide
GVNQGQCTRWRWMCPPNGWE

SEQ ID NO: 1183 - protein, 20 aa, Artificial sequence
  Synthetic peptide
LADHGQCIRWPWMCPPEGWE

SEQ ID NO: 1184 - protein, 20 aa, Artificial sequence
  Synthetic peptide
ILEQAQCTRWPWMCPPQRGG

SEQ ID NO: 1185 - protein, 20 aa, Artificial sequence
  Synthetic peptide
TQTHAQCTRWPWMCPPQWEG

SEQ ID NO: 1186 - protein, 20 aa, Artificial sequence
  Synthetic peptide
VVTQGHCTLWPWMCPPQRWR

SEQ ID NO: 1187 - protein, 20 aa, Artificial sequence
  Synthetic peptide
IYPHDQCTRWPWMCPPQPYP

SEQ ID NO: 1188 - protein, 20 aa, Artificial sequence
  Synthetic peptide
SYWQGQCTRWPWMCPPQWRG

SEQ ID NO: 1189 - protein, 20 aa, Artificial sequence
  Synthetic peptide
MWQQGHCTRWPWMCPPQGWG

SEQ ID NO: 1190 - protein, 20 aa, Artificial sequence
  Synthetic peptide
EFTQWHCTRWPWMCPPQRSQ

SEQ ID NO: 1191 - protein, 20 aa, Artificial sequence
  Synthetic peptide
LDDQWQCTRWPWMCPPQGFS

SEQ ID NO: 1192 - protein, 20 aa, Artificial sequence
  Synthetic peptide
YQTQGLCTRWPWMCPPQSQR

SEQ ID NO: 1193 - protein, 20 aa, Artificial sequence
  Synthetic peptide
ESNQGQCTRWPWMCPPQGGW

SEQ ID NO: 1194 - protein, 20 aa, Artificial sequence
  Synthetic peptide
WTDRGPCTRWPWMCPPQANG

SEQ ID NO: 1195 - protein, 20 aa, Artificial sequence
  Synthetic peptide
VGTQGQCTRWPWMCPPYETG

SEQ ID NO: 1196 - protein, 20 aa, Artificial sequence
  Synthetic peptide
PYEQGKCTRWPWMCPPYEVE

SEQ ID NO: 1197 - protein, 20 aa, Artificial sequence
  Synthetic peptide
SEYQGLCTRWPWMCPPQGWK

SEQ ID NO: 1198 - protein, 20 aa, Artificial sequence
  Synthetic peptide
TFSQGHCTRWPWMCPPQGWG

SEQ ID NO: 1199 - protein, 20 aa, Artificial sequence
  Synthetic peptide
PGAHDHCTRWPWMCPPQSRY

SEQ ID NO: 1200 - protein, 20 aa, Artificial sequence
  Synthetic peptide
VAEEWHCRRWPWMCPPQDWR

SEQ ID NO: 1201 - protein, 20 aa, Artificial sequence
  Synthetic peptide
VGTQGHCTRWPWMCPPQPAG

SEQ ID NO: 1202 - protein, 20 aa, Artificial sequence
  Synthetic peptide
EEDQAHCRSWPWMCPPQGWV

SEQ ID NO: 1203 - protein, 20 aa, Artificial sequence
  Synthetic peptide
ADTQGHCTRWPWMCPPQHWF

SEQ ID NO: 1204 - protein, 20 aa, Artificial sequence
  Synthetic peptide
SGPQGHCTRWPWMCAPQGWF

SEQ ID NO: 1205 - protein, 20 aa, Artificial sequence
  Synthetic peptide
TLVQGHCTRWPWMCPPQRWV

SEQ ID NO: 1206 - protein, 20 aa, Artificial sequence
  Synthetic peptide
GMAHGKCTRWAWMCPPQSWK

SEQ ID NO: 1207 - protein, 20 aa, Artificial sequence
  Synthetic peptide
ELYHGQCTRWPWMCPPQSWA

SEQ ID NO: 1208 - protein, 20 aa, Artificial sequence
  Synthetic peptide
VADHGHCTRWPWMCPPQGWG

SEQ ID NO: 1209 - protein, 20 aa, Artificial sequence
  Synthetic peptide
PESQGHCTRWPWMCPPQGWG

SEQ ID NO: 1210 - protein, 20 aa, Artificial sequence
  Synthetic peptide
IPAHGHCTRWPWMCPPQRWR

SEQ ID NO: 1211 - protein, 20 aa, Artificial sequence
  Synthetic peptide
FTVHGHCTRWPWMCPPYGWV

SEQ ID NO: 1212 - protein, 20 aa, Artificial sequence
  Synthetic peptide
PDFPGHCTRWRWMCPPQGWE

SEQ ID NO: 1213 - protein, 20 aa, Artificial sequence
  Synthetic peptide
QLWQGPCTQWPWMCPPKGRY

SEQ ID NO: 1214 - protein, 20 aa, Artificial sequence
  Synthetic peptide
HANDGHCTRWQWMCPPQWGG

SEQ ID NO: 1215 - protein, 20 aa, Artificial sequence
  Synthetic peptide
ETDHGLCTRWPWMCPPYGAR

SEQ ID NO: 1216 - protein, 20 aa, Artificial sequence
  Synthetic peptide
GTWQGLCTRWPWMCPPQGWQ

SEQ ID NO: 1217 - protein, 20 aa, Artificial sequence
  Synthetic peptide
VATQGQCTRWPWMCPPQGWG

SEQ ID NO: 1218 - protein, 20 aa, Artificial sequence
  Synthetic peptide
VATQGQCTRWPWMCPPQRWG

SEQ ID NO: 1219 - protein, 20 aa, Artificial sequence
  Synthetic peptide
QREWYPCYGGHLWCYDLHKA

SEQ ID NO: 1220 - protein, 20 aa, Artificial sequence
  Synthetic peptide
ISAWYSCYAGHFWCWDLKQK

SEQ ID NO: 1221 - protein, 20 aa, Artificial sequence
  Synthetic peptide
WTGWYQCYGGHLWCYDLRRK

SEQ ID NO: 1222 - protein, 20 aa, Artificial sequence
  Synthetic peptide
KTFWYPCYDGHFWCYNLKSS

SEQ ID NO: 1223 - protein, 20 aa, Artificial sequence
  Synthetic  peptide
ESRWYPCYEGHLWCFDLTET

SEQ ID NO: 1224 - protein, 20 aa, Artificial sequence
  Synthetic peptide
MEMLDSLFELLKDMVPISKA

SEQ ID NO: 1225 - protein, 22 aa, Artificial sequence
  Synthetic peptide
RMEMLESLLELLKEIVPMSKAG

SEQ ID NO: 1226 - protein, 22 aa, Artificial sequence
  Synthetic peptide
RMEMLESLLELLKEIVPMSKAR

SEQ ID NO: 1227 - protein, 22 aa, Artificial sequence
  Synthetic peptide
RMEMLESLLELLKDIVPMSKPS

SEQ ID NO: 1228 - protein, 22 aa, Artificial sequence
  Synthetic peptide
GMEMLESLFELLQEIVPMSKAP

SEQ ID NO: 1229 - protein, 22 aa, Artificial sequence
  Synthetic peptide
RMEMLESLLELLKDIVPISNPP

SEQ ID NO: 1230 - protein, 22 aa, Artificial sequence
  Synthetic peptide
RIEMLESLLELLQEIVPISKAE

SEQ ID NO: 1231 - protein, 22 aa, Artificial sequence
  Synthetic peptide
RMEMLQSLLELLKDIVPMSNAR

SEQ ID NO: 1232 - protein, 22 aa, Artificial sequence
  Synthetic peptide
RMEMLESLLELLKEIVPTSNGT

SEQ ID NO: 1233 - protein, 22 aa, Artificial sequence
  Synthetic peptide
RMEMLESLFELLKEIVPMSKAG

SEQ ID NO: 1234 - protein, 22 aa, Artificial sequence
  Synthetic peptide
RMEMLGSLLELLKEIVPMSKAR

SEQ ID NO: 1235 - protein, 22 aa, Artificial sequence
  Synthetic peptide
QMELLDSLFELLKEIVPKSQPA

SEQ ID NO: 1236 - protein, 22 aa, Artificial sequence
  Synthetic peptide
RMEMLDSLLELLKEIVPMSNAR

SEQ ID NO: 1237 - protein, 22 aa, Artificial sequence
  Synthetic peptide
RMEMLESLLELLHEIVPMSQAG

SEQ ID NO: 1238 - protein, 22 aa, Artificial sequence
  Synthetic peptide
QMEMLESLLQLLKEIVPMSKAS

SEQ ID NO: 1239 - protein, 22 aa, Artificial sequence
  Synthetic peptide
RMEMLDSLLELLKDMVPMTTGA

SEQ ID NO: 1240 - protein, 22 aa, Artificial sequence
  Synthetic peptide
RIEMLESLLELLKDMVPMANAS

SEQ ID NO: 1241 - protein, 22 aa, Artificial sequence
  Synthetic peptide
RMEMLESLLQLLNEIVPMSRAR

SEQ ID NO: 1242 - protein, 22 aa, Artificial sequence
  Synthetic peptide
RMEMLESLFDLLKELVPMSKGV

SEQ ID NO: 1243 - protein, 22 aa, Artificial sequence
  Synthetic peptide
RIEMLESLLELLKDIVPIQKAR

SEQ ID NO: 1244 - protein, 22 aa, Artificial sequence
  Synthetic peptide
RMELLESLFELLKDMVPMSDSS

SEQ ID NO: 1245 - protein, 22 aa, Artificial sequence
  Synthetic peptide
RMEMLESLLEVLQEIVPRAKGA

SEQ ID NO: 1246 - protein, 22 aa, Artificial sequence
  Synthetic peptide
RMEMLDSLLQLLNEIVPMSHAR

SEQ ID NO: 1247 - protein, 22 aa, Artificial sequence
  Synthetic peptide
RMEMLESLLELLKDIVPMSNAG

SEQ ID NO: 1248 - protein, 22 aa, Artificial sequence
  Synthetic peptide
RMEMLQSLFELLKGMVPISKAG

SEQ ID NO: 1249 - protein, 22 aa, Artificial sequence
  Synthetic peptide
RMEMLESLLELLKEIVPNSTAA

SEQ ID NO: 1250 - protein, 22 aa, Artificial sequence
  Synthetic peptide
RMEMLQSLLELLKEIVPISKAG

SEQ ID NO: 1251 - protein, 22 aa, Artificial sequence
  Synthetic peptide
RIEMLDSLLELLNELVPMSKAR

SEQ ID NO: 1252 - protein, 20 aa, Artificial sequence
  Synthetic peptide
HHGWNYLRKGSAPQWFEAWV

SEQ ID NO: 1253 - protein, 22 aa, Artificial sequence
  Synthetic peptide
QVESLQQLLMWLDQKLASGPQG

SEQ ID NO: 1254 - protein, 22 aa, Artificial sequence
  Synthetic peptide
RMELLESLFELLKEMVPRSKAV

SEQ ID NO: 1255 - protein, 22 aa, Artificial sequence
  Synthetic peptide
QAVSLQHLLMWLDQKLASGPQH

SEQ ID NO: 1256 - protein, 22 aa, Artificial sequence
  Synthetic peptide
DEDSLQQLLMWLDQKLASGPQL

SEQ ID NO: 1257 - protein, 22 aa, Artificial sequence
  Synthetic peptide
PVASLQQLLIWLDQKLAQGPHA

SEQ ID NO: 1258 - protein, 22 aa, Artificial sequence
  Synthetic peptide
EVDELQQLLNWLDHKLASGPLQ

SEQ ID NO: 1259 - protein, 22 aa, Artificial sequence
  Synthetic peptide
DVESLEQLLMWLDHQLASGPHG

SEQ ID NO: 1260 - protein, 22 aa, Artificial sequence
  Synthetic peptide
QVDSLQQVLLWLEHKLALGPQV

SEQ ID NO: 1261 - protein, 22 aa, Artificial sequence
  Synthetic peptide
GDESLQHLLMWLEQKLALGPHG

SEQ ID NO: 1262 - protein, 22 aa, Artificial sequence
  Synthetic peptide
QIEMLESLLDLLRDMVPMSNAF

SEQ ID NO: 1263 - protein, 22 aa, Artificial sequence
  Synthetic peptide
EVDSLQQLLMWLDQKLASGPQA

SEQ ID NO: 1264 - protein, 22 aa, Artificial sequence
  Synthetic peptide
EDESLQQLLIYLDKMLSSGPQV

SEQ ID NO: 1265 - protein, 22 aa, Artificial sequence
  Synthetic peptide
AMDQLHQLLIWLDHKLASGPQA

SEQ ID NO: 1266 - protein, 22 aa, Artificial sequence
  Synthetic peptide
RIEMLESLLELLDEIALIPKAW

SEQ ID NO: 1267 - protein, 22 aa, Artificial sequence
  Synthetic peptide
EVVSLQHLLMWLEHKLASGPDG

SEQ ID NO: 1268 - protein, 22 aa, Artificial sequence
  Synthetic peptide
GGESLQQLLMWLDQQLASGPQR

SEQ ID NO: 1269 - protein, 22 aa, Artificial sequence
  Synthetic peptide
GVESLQQLLIFLDHMLVSGPHD

SEQ ID NO: 1270 - protein, 22 aa, Artificial sequence
  Synthetic peptide
NVESLEHLMMWLERLLASGPYA

SEQ ID NO: 1271 - protein, 22 aa, Artificial sequence
  Synthetic peptide
QVDSLQQLLIWLDHQLASGPKR

SEQ ID NO: 1272 - protein, 22 aa, Artificial sequence
  Synthetic peptide
EVESLQQLLMWLEHKLAQGPQG

SEQ ID NO: 1273 - protein, 22 aa, Artificial sequence
  Synthetic peptide
EVDSLQQLLMWLDQKLASGPHA

SEQ ID NO: 1274 - protein, 22 aa, Artificial sequence
  Synthetic peptide
EVDSLQQLLMWLDQQLASGPQK

SEQ ID NO: 1275 - protein, 22 aa, Artificial sequence
  Synthetic peptide
GVEQLPQLLMWLEQKLASGPQR

SEQ ID NO: 1276 - protein, 22 aa, Artificial sequence
  Synthetic peptide
GEDSLQQLLMWLDQQLAAGPQV

SEQ ID NO: 1277 - protein, 22 aa, Artificial sequence
  Synthetic peptide
ADDSLQQLLMWLDRKLASGPHV

SEQ ID NO: 1278 - protein, 22 aa, Artificial sequence
  Synthetic peptide
PVDSLQQLLIWLDQKLASGPQG

SEQ ID NO: 1279 - protein, 18 aa, Artificial sequence
  Synthetic peptide
RATLLKDFWQLVEGYGDN

SEQ ID NO: 1280 - protein, 22 aa, Artificial sequence
  Synthetic peptide
DWRATLLKEFWQLVEGLGDNLV

SEQ ID NO: 1281 - protein, 22 aa, Artificial sequence
  Synthetic peptide
QSRATLLKEFWQLVEGLGDKQA

SEQ ID NO: 1282 - protein, 22 aa, Artificial sequence
  Synthetic peptide
DGRATLLTEFWQLVQGLGQKEA

SEQ ID NO: 1283 - protein, 22 aa, Artificial sequence
  Synthetic peptide
LARATLLKEFWQLVEGLGEKVV

SEQ ID NO: 1284 - protein, 22 aa, Artificial sequence
  Synthetic peptide
GSRDTLLKEFWQLVVGLGDMQT

SEQ ID NO: 1285 - protein, 22 aa, Artificial sequence
  Synthetic peptide
DARATLLKEFWQLVDAYGDRMV

SEQ ID NO: 1286 - protein, 22 aa, Artificial sequence
  Synthetic peptide
NDRAQLLRDFWQLVDGLGVKSW

SEQ ID NO: 1287 - protein, 22 aa, Artificial sequence
  Synthetic peptide
GVRETLLYELWYLLKGLGANQG

SEQ ID NO: 1288 - protein, 22 aa, Artificial sequence
  Synthetic peptide
QARATLLKEFCQLVGCQGDKLS

SEQ ID NO: 1289 - protein, 22 aa, Artificial sequence
  Synthetic peptide
QERATLLKEFWQLVAGLGQNMR

SEQ ID NO: 1290 - protein, 22 aa, Artificial sequence
  Synthetic peptide
SGRATLLKEFWQLVQGLGEYRW

SEQ ID NO: 1291 - protein, 22 aa, Artificial sequence
  Synthetic peptide
TMRATLLKEFWLFVDGQREMQW

SEQ ID NO: 1292 - protein, 22 aa, Artificial sequence
  Synthetic peptide
GERATLLNDFWQLVDGQGDNTG

SEQ ID NO: 1293 - protein, 22 aa, Artificial sequence
  Synthetic peptide
DERETLLKEFWQLVHGWGDNVA

SEQ ID NO: 1294 - protein, 22 aa, Artificial sequence
  Synthetic peptide
GGRATLLKELWQLLEGQGANLV

SEQ ID NO: 1295 - protein, 22 aa, Artificial sequence
  Synthetic peptide
TARATLLNELVQLVKGYGDKLV

SEQ ID NO: 1296 - protein, 22 aa, Artificial sequence
  Synthetic peptide
GMRATLLQEFWQLVGGQGDNWM

SEQ ID NO: 1297 - protein, 22 aa, Artificial sequence
  Synthetic peptide
STRATLLNDLWQLMKGWAEDRG

SEQ ID NO: 1298 - protein, 22 aa, Artificial sequence
  Synthetic peptide
SERATLLKELWQLVGGWGDNFG

SEQ ID NO: 1299 - protein, 22 aa, Artificial sequence
  Synthetic peptide
VGRATLLKEFWQLVEGLVGQSR

SEQ ID NO: 1300 - protein, 22 aa, Artificial sequence
  Synthetic peptide
EIRATLLKEFWQLVDEWREQPN

SEQ ID NO: 1301 - protein, 22 aa, Artificial sequence
  Synthetic peptide
QLRATLLKEFLQLVHGLGETDS

SEQ ID NO: 1302 - protein, 22 aa, Artificial sequence
  Synthetic peptide
TQRATLLKEFWQLIEGLGGKHV

SEQ ID NO: 1303 - protein, 22 aa, Artificial sequence
  Synthetic peptide
HYRATLLKEFWQLVDGLREQGV

SEQ ID NO: 1304 - protein, 22 aa, Artificial sequence
  Synthetic peptide
QSRVTLLREFWQLVESYRPIVN

SEQ ID NO: 1305 - protein, 22 aa, Artificial sequence
  Synthetic peptide
LSRATLLNEFWQFVDGQRDKRM

SEQ ID NO: 1306 - protein, 22 aa, Artificial sequence
  Synthetic peptide
WDRATLLNDFWHLMEELSQKPG

SEQ ID NO: 1307 - protein, 22 aa, Artificial sequence
  Synthetic peptide
QERATLLKEFWRMVEGLGKNRG

SEQ ID NO: 1308 - protein, 22 aa, Artificial sequence
  Synthetic peptide
NERATLLREFWQLVGGYGVNQR

SEQ ID NO: 1309 - protein, 20 aa, Artificial sequence
  Synthetic peptide
YREMSMLEGLLDVLERLQHY

SEQ ID NO: 1310 - protein, 22 aa, Artificial sequence
  Synthetic peptide
HQRDMSMLWELLDVLDGLRQYS

SEQ ID NO: 1311 - protein, 22 aa, Artificial sequence
  Synthetic peptide
TQRDMSMLDGLLEVLDQLRQQR

SEQ ID NO: 1312 - protein, 22 aa, Artificial sequence
  Synthetic peptide
TSRDMSLLWELLEELDRLGHQR

SEQ ID NO: 1313 - protein, 22 aa, Artificial sequence
  Synthetic peptide
MQHDMSMLYGLVELLESLGHQI

SEQ ID NO: 1314 - protein, 22 aa, Artificial sequence
  Synthetic peptide
WNRDMRMLESLFEVLDGLRQQV

SEQ ID NO: 1315 - protein, 22 aa, Artificial sequence
  Synthetic peptide
GYRDMSMLEGLLAVLDRLGPQL

SEQ ID NO: 1316 - protein, 22 aa, Artificial sequence
  Synthetic peptide
TQRDMSMLEGLLEVLDRLGQQR

SEQ ID NO: 1317 - protein, 22 aa, Artificial sequence
  Synthetic peptide
WYRDMSMLEGLLEVLDRLGQQR

SEQ ID NO: 1318 - protein, 20 aa, Artificial sequence
  Synthetic peptide
HNSSQMLLSELIMLVGSMMQ

SEQ ID NO: 1319 - protein, 22 aa, Artificial sequence
  Synthetic peptide
TQNSRQMLLSDFMMLVGSMIQG

SEQ ID NO: 1320 - protein, 22 aa, Artificial sequence
  Synthetic peptide
MQTSRHILLSEFMMLVGSIMHG

SEQ ID NO: 1321 - protein, 22 aa, Artificial sequence
  Synthetic peptide
HDNSRQMLLSDLLHLVGTMIQG

SEQ ID NO: 1322 - protein, 22 aa, Artificial sequence
  Synthetic peptide
MENSRQNLLRELIMLVGNMSHQ

SEQ ID NO: 1323 - protein, 22 aa, Artificial sequence
  Synthetic peptide
QDTSRHMLLREFMMLVGEMIQG

SEQ ID NO: 1324 - protein, 22 aa, Artificial sequence
  Synthetic peptide
DQNSRQMLLSDLMILVGSMIQG

SEQ ID NO: 1325 - protein, 20 aa, Artificial sequence
  Synthetic peptide
EFFHWLHNHRSEVNHWLDMN

SEQ ID NO: 1326 - protein, 22 aa, Artificial sequence
  Synthetic peptide
NVFFQWVQKHGRVVYQWLDINV

SEQ ID NO: 1327 - protein, 22 aa, Artificial sequence
  Synthetic peptide
FDFLQWLQNHRSEVEHWLVMDV

SEQ ID NO: 1328 - protein, 56 aa, Artificial sequence
  Synthetic peptide
MGAQWYPCYEGHFWCYDLGSGSATGGSGSTASSGSGSATGWYPCYEGHFWCYDLLE

SEQ ID NO: 1329 - protein, 54 aa, Artificial sequence
  Synthetic peptide
AQWYPCYEGHFWCYDLGSGSATGGSGSTASSGSGSATGWYPCYEGHFWCYDLLE

SEQ ID NO: 1330 - protein, 56 aa, Artificial sequence
  Synthetic peptide
MGAQIFGCKWWDVQCYQFGSGSATGGSGSTASSGSGSATGIFGCKWWDVQCYQFLE

SEQ ID NO: 1331 - protein, 54 aa, Artificial sequence
  Synthetic peptide
AQIFGCKWWDVQCYQFGSGSATGGSGSTASSGSGSATGIFGCKWWDVQCYQFLE

SEQ ID NO: 1332 - protein, 56 aa, Artificial sequence
  Synthetic peptide
MGAQIFGCKWWDVDCYQFGSGSATGGSGSTASSGSGSATGIFGCKWWDVDCYQFLE

SEQ ID NO: 1333 - protein, 54 aa, Artificial sequence
  Synthetic peptide
AQIFGCKWWDVDCYQFGSGSATGGSGSTASSGSGSATGIFGCKWWDVDCYQFLE

SEQ ID NO: 1334 - protein, 68 aa, Artificial sequence
  Synthetic peptide
AQLADHGQCIRWPWMCPPEGWELEGSGSATGGSGSTASSGSGSATGLADHGQCIRWPWMCPPEGWELE

SEQ ID NO: 1335 - protein, 64 aa, Artificial sequence
  Synthetic peptide
AQLADHGQCIRWPWMCPPEGWEGSGSATGGSGGGASSGSGSATGLADHGQCIRWPWMCPPEGWE

SEQ ID NO: 1336 - protein, 68 aa, Artificial sequence
  Synthetic peptide
AQSEYQGLCTRWPWMCPPQGWKLEGSGSATGGSGSTASSGSGSATGSEYQGLCTRWPWMCPPQGWKLE

SEQ ID NO: 1337 - protein, 64 aa, Artificial sequence
  Synthetic peptide
AQSEYQGLCTRWPWMCPPQGWKGSGSATGGSGGGASSGSGSATGSEYQGLCTRWPWMCPPQGWK

SEQ ID NO: 1338 - protein, 67 aa, Artificial sequence
  Synthetic peptide
AQTFSQGHCTRWPWMCPPQGWGLEGSGSATGGSGSTASSGSGSATGTFSQGHCTRWPWMCPPQGWGL

SEQ ID NO: 1339 - protein, 68 aa, Artificial sequence
  Synthetic peptide
AQVADHGHCTRWPWMCPPQGWGLEGSGSATGGSGSTASSGSGSATGVADHGHCTRWPWMCPPQGWGLE

SEQ ID NO: 1340 - protein, 64 aa, Artificial sequence
  Synthetic peptide
AQVADHGHCTRWPWMCPPQGWGGSGSATGGSGGGASSGSGSATGVADHGHCTRWPWVCPPQGWG

SEQ ID NO: 1341 - protein, 68 aa, Artificial sequence
  Synthetic peptide
AQPESQGHCTRWPWMCPPQGWGLEGSGSATGGSGSTASSGSGSATGPESQGHCTRWPWMCPPQGWGLE

SEQ ID NO: 1342 - protein, 64 aa, Artificial sequence
  Synthetic peptide
AQPESQGHCTRWPWMCPPQGWGGSGSATGGSGGGASSGSGSATGPESQGHCTRWPWMCPPQGWG

SEQ ID NO: 1343 - skipped

SEQ ID NO: 1344 - protein, 9 aa, Artificial sequence
  Synthetic peptide
CLCRGDCIC

SEQ ID NO: 1345 - protein, 8 aa, Artificial sequence
  Synthetic peptide
CWDDGWLC

SEQ ID NO: 1346 - protein, 9 aa, Artificial sequence
  Synthetic peptide
CWDDLWWLC

SEQ ID NO: 1347 - protein, 8 aa, Artificial sequence
  Synthetic peptide
CWDDGLMC

SEQ ID NO: 1348 - protein, 8 aa, Artificial sequence
  Synthetic peptide
CWDDGWMC

SEQ ID NO: 1349 - protein, 9 aa, Artificial sequence
  Synthetic peptide
CSWDDGWLC

SEQ ID NO: 1350 - protein, 9 aa, Artificial sequence
  Synthetic peptide
CPDDLWWLC

SEQ ID NO: 1351 - protein, 3 aa, Artificial sequence
  Synthetic peptide
NGR

SEQ ID NO: 1352 - protein, 3 aa, Artificial sequence
  Synthetic peptide
GSL

SEQ ID NO: 1353 - protein, 3 aa, Artificial sequence
  Synthetic peptide
RGD

SEQ ID NO: 1354 - protein, 13 aa, Artificial sequence
  Synthetic peptide
CGRECPRLCQSSC

SEQ ID NO: 1355 - protein, 13 aa, Artificial sequence
  Synthetic peptide
CNGRCVSGCAGRC

SEQ ID NO: 1356 - protein, 8 aa, Artificial sequence
  Synthetic peptide
CLSGSLSC

SEQ ID NO: 1357 - protein, 3 aa, Artificial sequence
  Synthetic peptide
GSL

SEQ ID NO: 1358 - protein, 6 aa, Artificial sequence
  Synthetic peptide
NGRAHA

SEQ ID NO: 1359 - protein, 5 aa, Artificial sequence
  Synthetic peptide
CNGRC

SEQ ID NO: 1360 - protein, 9 aa, Artificial sequence
  Synthetic peptide
CDCRGDCFC

SEQ ID NO: 1361 - protein, 7 aa, Artificial sequence
  Synthetic peptide
CGSLVRC

SEQ ID NO: 1362 - protein, 5 aa, Artificial sequence
  Synthetic peptide
  Misc feature (3)..(4): Xaa=any amino acid
DLXXL

SEQ ID NO: 1363 - protein, 12 aa, Artificial sequence
  Synthetic peptide
RTDLDSLRTYTL

SEQ ID NO: 1364 - protein, 10 aa, Artificial sequence
  Synthetic peptide
RTDLDSLRTY

SEQ ID NO: 1365 - protein, 9 aa, Artificial sequence
  Synthetic peptide
RTDLDSLRT

SEQ ID NO: 1366 - protein, 8 aa, Artificial sequence
  Synthetic peptide
RTDLDSLR

SEQ ID NO: 1367 - protein, 12 aa, Artificial sequence
  Synthetic peptide
GDLDLLKLRLTL

SEQ ID NO: 1368 - protein, 12 aa, Artificial sequence
  Synthetic peptide
GDLHSLRQLLSR

SEQ ID NO: 1369 - protein, 12 aa, Artificial sequence
  Synthetic peptide
RDDLHMLRLQLW

SEQ ID NO: 1370 - protein, 12 aa, Artificial sequence
  Synthetic peptide
SSDLHALKKRYG

SEQ ID NO: 1371 - protein, 12 aa, Artificial sequence
  Synthetic peptide
RGDLKQLSELTW

SEQ ID NO: 1372 - protein, 7 aa, Artificial sequence
  Synthetic peptide
  Misc feature (2)..(3): Xaa=any amino acid
CXXRGDC

SEQ ID NO: 1373 - protein, 27 aa, Artificial sequence
  Synthetic peptide
STGGFDDVYDWARGVSSALTTTLVATR

SEQ ID NO: 1374 - protein, 27 aa, Artificial sequence
  Synthetic peptide
STGGFDDVYDWARRVSSALTTTLVATR

SEQ ID NO: 1375 - protein, 30 aa, Artificial sequence; identical to SEQ ID NO: 941
  Synthetic peptide

SEQ ID NO: 1376 - protein, 30 aa, Artificial sequence; identical to SEQ ID NO: 942
  Synthetic peptide

SEQ ID NO: 1377 - protein, 31 aa, Artificial sequence; identical to SEQ ID NO: 943
  Synthetic peptide

SEQ ID NO: 1378 - protein, 31 aa, Artificial sequence; identical to SEQ ID NO: 944
  Synthetic peptide

SEQ ID NO: 1379 - protein, 18 aa, Artificial sequence
  Synthetic peptide
DVYTKKELIECARRVSEK

SEQ ID NO: 1380 - protein, 5 aa, Artificial sequence
  Synthetic peptide
  Misc feature (5)..(5): Xaa=any amino acid
RGDGX

SEQ ID NO: 1381 - protein, 7 aa, Artificial sequence
  Synthetic peptide
  Misc feature (6)..(6): Xaa=any amino acid
CRGDGXC

SEQ ID NO: 1382 - protein, 9 aa, Artificial sequence
  Synthetic peptide
CARRLDAPC

SEQ ID NO: 1383 - protein, 9 aa, Artificial sequence
  Synthetic peptide
CPSRLDSPC

SEQ ID NO: 1384 - protein, 9 aa, Artificial sequence
  Synthetic peptide
CDCRGDCFC

SEQ ID NO: 1385 - protein, 9 aa, Artificial sequence
  Synthetic peptide
CDCRGDCLC

SEQ ID NO: 1386 - protein, 12 aa, Artificial sequence
  Synthetic peptide
RGDLAALSAPPV

SEQ ID NO: 1387 - protein, 12 aa, Artificial sequence
  Synthetic peptide
DITWDQLWDLMK

SEQ ID NO: 1388 - protein, 12 aa, Artificial sequence
  Synthetic peptide
DITWDELWKIMN

SEQ ID NO: 1389 - protein, 12 aa, Artificial sequence
  Synthetic peptide
DYTWFELWDMMQ

SEQ ID NO: 1390 - protein, 12 aa, Artificial sequence
  Synthetic peptide
QITWAQLWNMMK

SEQ ID NO: 1391 - protein, 12 aa, Artificial sequence
  Synthetic peptide
DMTWHDLWTLMS

SEQ ID NO: 1392 - protein, 12 aa, Artificial sequence
  Synthetic peptide
DYSWHDLWEMMS

SEQ ID NO: 1393 - protein, 12 aa, Artificial sequence
  Synthetic peptide
EITWDQLWEVMN

SEQ ID NO: 1394 - protein, 12 aa, Artificial sequence
  Synthetic peptide
HVSWEQLWDIMN

SEQ ID NO: 1395 - protein, 12 aa, Artificial sequence
  Synthetic peptide
HITWDQLWRIMT

SEQ ID NO: 1396 - protein, 13 aa, Artificial sequence
  Synthetic peptide
RNMSWLELWEHMK

SEQ ID NO: 1397 - protein, 18 aa, Artificial sequence
  Synthetic peptide
AEWTWDQLWHVMNPAESQ

SEQ ID NO: 1398 - protein, 14 aa, Artificial sequence
  Synthetic peptide
HRAEWLALWEQMSP

SEQ ID NO: 1399 - protein, 14 aa, Artificial sequence
  Synthetic peptide
KKEDWLALWRIMSV

SEQ ID NO: 1400 - protein, 11 aa, Artificial sequence
  Synthetic peptide
ITWDQLWDLMK

SEQ ID NO: 1401 - protein, 12 aa, Artificial sequence
  Synthetic peptide
DITWDQLWDLMK

SEQ ID NO: 1402 - protein, 12 aa, Artificial sequence
  Synthetic peptide
DITWDQLWDLMK

SEQ ID NO: 1403 - protein, 12 aa, Artificial sequence
  Synthetic peptide
DITWDQLWDLMK

SEQ ID NO: 1404 - protein, 16 aa, Artificial sequence
  Synthetic peptide
CQNRYTDLVAIQNKNE

SEQ ID NO: 1405 - protein, 17 aa, Artificial sequence
  Synthetic peptide
AENWADNEPNNKRNNED

SEQ ID NO: 1406 - protein, 19 aa, Artificial sequence
  Synthetic peptide
RKNNKTWTWVGTKKALTNE

SEQ ID NO: 1407 - protein, 13 aa, Artificial sequence
  Synthetic peptide
KKALTNEAENWAD

SEQ ID NO: 1408 - protein, 16 aa, Artificial sequence
  Synthetic peptide
  Misc feature (3)..(3): Xaa=any amino acid
  Misc feature (15)..(15): Xaa=any amino acid
CQXRYTDLVAIQNKXE

SEQ ID NO: 1409 - protein, 17 aa, Artificial sequence
  Synthetic peptide
  Misc feature (13)..(13): Xaa=any amino acid
  Misc feature (15)..(15): Xaa=any amino acid
AENWADGEPNNKXNXED

SEQ ID NO: 1410 - protein, 30 aa, Artificial sequence; identical to SEQ ID NO: 942
  Synthetic peptide

SEQ ID NO: 1411 - protein, 31 aa, Artificial sequence; identical to SEQ ID NO: 943
  Synthetic peptide

SEQ ID NO: 1412 - protein, 31 aa, Artificial sequence; identical to SEQ ID NO: 944
  Synthetic peptide

SEQ ID NO: 1413 - protein, 18 aa, Artificial sequence
  Synthetic peptide
DVYTKKELIECARRVSEK

SEQ ID NO: 1414 - protein, 27 aa, Artificial sequence
  Synthetic peptide
STGGFDDVYDWARGVSSALTTTLVATR

SEQ ID NO: 1415 - protein, 27 aa, Artificial sequence
  Synthetic peptide
STGGFDDVYDWARRVSSALTTTLVATR

SEQ ID NO: 1416 - protein, 30 aa, Artificial sequence; identical to SEQ ID NO: 941
  Synthetic peptide

SEQ ID NO: 1417 - protein, 20 aa, Artificial sequence
  Synthetic peptide
YIGSRYIGSRYIGSRYIGSR

SEQ ID NO: 1418 - protein, 45 aa, Artificial sequence
  Synthetic peptide
YIGSRYIGSRYIGSRYIGSRYIGSRYIGSRYIGSRYIGSRYIGSR

SEQ ID NO: 1419 - protein, 80 aa, Artificial sequence
  Synthetic peptide
YIGSRYIGSRYIGSRYIGSRYIGSRYIGSRYIGSRYIGSRYIGSRYIGSRYIGSRYIGSRYIGSRYIGSRYIGSRYIGSR

SEQ ID NO: 1420 - protein, 125 aa, Artificial sequence
  Synthetic peptide
YIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSRYIGSR

SEQ ID NO: 1421 - protein, 20 aa, Artificial sequence
  Synthetic peptide
IPCNNKGAHSVGLMWWMLAR

SEQ ID NO: 1422 - protein, 19 aa, Artificial sequence
  Synthetic peptide
YIGSRREDVEILDVPDSGR

SEQ ID NO: 1423 - protein, 14 aa, Artificial sequence
  Synthetic peptide
RGDRGDYIGSRRGD

SEQ ID NO: 1424 - protein, 25 aa, Artificial sequence
  Synthetic peptide
YIGSRYIGSRYIGSRYIGSRYIGSR

SEQ ID NO: 1425 - protein, 19 aa, Artificial sequence
  Synthetic peptide
REDVEILDVYIGSRPDSGR

SEQ ID NO: 1426 - protein, 19 aa, Artificial sequence
  Synthetic peptide
YIGSRREDVEILDVPDSGR

SEQ ID NO: 1427 - protein, 20 aa, Artificial sequence
  Synthetic peptide
TGYTEYTEEWPMGFGYQWSF

SEQ ID NO: 1428 - protein, 20 aa, Artificial sequence
  Synthetic peptide
TDWLSDFPFYEQYFGLMPPG

SEQ ID NO: 1429 - protein, 20 aa, Artificial sequence
  Synthetic peptide
FMRFPNPWKLVEPPQGWYYG

SEQ ID NO: 1430 - protein, 20 aa, Artificial sequence
  Synthetic peptide
VVKAPHFEFLAPPHFHEFPF

SEQ ID NO: 1431 - protein, 20 aa, Artificial sequence
  Synthetic peptide
FSYIWIDETPSNIDRYMLWL

SEQ ID NO: 1432 - protein, 20 aa, Artificial sequence
  Synthetic peptide
VNFPKVPEDVEPWPWSLKLY

SEQ ID NO: 1433 - protein, 20 aa, Artificial sequence
  Synthetic peptide
TWHPKTYEEFALPFFVPEAP

SEQ ID NO: 1434 - protein, 20 aa, Artificial sequence
  Synthetic peptide
WHFGTPYIQQQPGVYWLQAP

SEQ ID NO: 1435 - protein, 20 aa, Artificial sequence
  Synthetic peptide
VWNYGPFFMNFPDSTYFLHE

SEQ ID NO: 1436 - protein, 20 aa, Artificial sequence
  Synthetic peptide
WRIHSKPLDYSHVWFFPADF

SEQ ID NO: 1437 - protein, 20 aa, Artificial sequence
  Synthetic peptide
FWDGNQPPDILVDWPWNPPV

SEQ ID NO: 1438 - protein, 20 aa, Artificial sequence
  Synthetic peptide
FYSLEWLKDHSEFFQTVTEW

SEQ ID NO: 1439 - protein, 20 aa, Artificial sequence
  Synthetic peptide
QFMELLKFFNSPGDSSHHFL

SEQ ID NO: 1440 - protein, 20 aa, Artificial sequence
  Synthetic peptide
TNVDWISNNWEHMKSFFTED

SEQ ID NO: 1441 - protein, 20 aa, Artificial sequence
  Synthetic peptide
PNEKPYQMQSWFPPDWPVPY

SEQ ID NO: 1442 - protein, 20 aa, Artificial sequence
  Synthetic peptide
WSHTEWVPQVWWKPPNHFYV

SEQ ID NO: 1443 - protein, 20 aa, Artificial sequence
  Synthetic peptide
WGEWINDAQVHMHEGFISES

SEQ ID NO: 1444 - protein, 20 aa, Artificial sequence
  Synthetic peptide
VPWEHDHDLWEIISQDWHIA

SEQ ID NO: 1445 - protein, 20 aa, Artificial sequence
  Synthetic peptide
VLHLQDPRGWSNFPPGVLEL

SEQ ID NO: 1446 - protein, 14 aa, Artificial sequence
  Synthetic peptide
IHGCWFTEEGCVWQ

SEQ ID NO: 1447 - protein, 14 aa, Artificial sequence
  Synthetic peptide
YMQCQFARDGCPQW

SEQ ID NO: 1448 - protein, 14 aa, Artificial sequence
  Synthetic peptide
KLQCQYSESGCPTI

SEQ ID NO: 1449 - protein, 14 aa, Artificial sequence
  Synthetic peptide
FLQCEISGGACPAP

SEQ ID NO: 1450 - protein, 14 aa, Artificial sequence
  Synthetic peptide
KLQCEFSTSGCPDL

SEQ ID NO: 1451 - protein, 14 aa, Artificial sequence
  Synthetic peptide
KLQCEFSTQGCPDL

SEQ ID NO: 1452 - protein, 14 aa, Artificial sequence
  Synthetic peptide
KLQCEFSTSGCPWL

SEQ ID NO: 1453 - protein, 14 aa, Artificial sequence
  Synthetic peptide
IQGCWFTEEGCPWQ

SEQ ID NO: 1454 - protein, 18 aa, Artificial sequence
  Synthetic peptide
SFDCDNPWGHVLQSCFGF

SEQ ID NO: 1455 - protein, 18 aa, Artificial sequence
  Synthetic peptide
SFDCDNPWGHKLQSCFGF

SEQ ID NO: 1456 - protein, 18 aa, Artificial sequence
  Synthetic peptide
  BINDING (18)..(18): Linker protein bound to residue 18
LPGCKWDLLIKQWVCDPL

SEQ ID NO: 1457 - protein, 18 aa, Artificial sequence
  Synthetic peptide
  MISC FEATURE (1)..(1): Linker protein bound to residue 1
LPGCKWDLLIKQWVCDPL

SEQ ID NO: 1458 - protein, 36 aa, Artificial sequence
  Synthetic peptide
  Misc feature (18)..(19): Linker protein between residues 18 and 19
  Binding (36)..(36): Linker protein bound to residue 36
LPGCKWDLLIKQWVCDPLLPGCKWDLLIKQWVCDPL

SEQ ID NO: 1459 - protein, 36 aa, Artificial sequence; identical to SEQ ID NO: 1458
  Synthetic peptide
  Binding (1)..(1): Linker protein bound to residue 1
  Misc feature (18)..(19): Linker protein between residues 18 and 19

SEQ ID NO: 1460 - protein, 18 aa, Artificial sequence
  Synthetic peptide
  Binding (18)..(18): Linker protein bound to residue 18
SADCYFDILTKSDVCTSS

SEQ ID NO: 1461 - protein, 18 aa, Artificial sequence
  Synthetic peptide
  Binding (1)..(1): Linker protein bound to residue 1
SADCYFDILTKSDVCTSS

SEQ ID NO: 1462 - protein, 34 aa, Artificial sequence
  Synthetic peptide
  Misc feature (17)..(18): Linker protein between residues 17 and 18
  Binding (34)..(34): Linker protein bound to residue 34
SADCYFDILTKSDVTSSSADCYFDILTKSDVTSS

SEQ ID NO: 1463 - protein, 34 aa, Artificial sequence; identical to SEQ ID NO: 1462
  Synthetic peptide
  Binding (1)..(1): Linker protein bound to residue 1
  Misc feature (17)..(18): Linker protein between residues 17 and 18

SEQ ID NO: 1464 - protein, 18 aa, Artificial sequence
  Synthetic peptide
  Binding (18)..(18): Linker protein bound to residue 18
FHDCKWDLLTKQWVCHGL

SEQ ID NO: 1465 - protein, 18 aa, Artificial sequence
  Synthetic peptide
  Binding (1)..(1): Linker protein bound to residue 1
FHDCKWDLLTKQWVCHGL

SEQ ID NO: 1466 - protein, 36 aa, Artificial sequence
  Synthetic peptide
  Misc feature (18)..(19): Linker protein between residues 18 and 19
  Binding (36)..(36): Linker protein bound to residue 36
FHDCKWDLLTKQWVCHGLFHDCKWDLLTKQWVCHGL

SEQ ID NO: 1467 - protein, 36 aa, Artificial sequence; identical to SEQ ID NO: 1466
  Synthetic peptide
  Binding (1)..(1): Linker protein bound to residue 1
  Misc feature (18)..(19): Linker protein between residues 18 and 19

SEQ ID NO: 1468 - protein, 248 aa, Artificial sequence
  Synthetic peptide
MPGTCFPFPWECTHAGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1469 - protein, 248 aa, Artificial sequence
  Synthetic peptide
MWGACWPFPWECFKEGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1470 - protein, 248 aa, Artificial sequence
  Synthetic peptide
MVPFCDLLTKHCFEAGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1471 - protein, 252 aa, Artificial sequence
  Synthetic peptide
MGSRCKYKWDVLTKQCFHHGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1472 - protein, 252 aa, Artificial sequence
  Synthetic peptide
MLPGCKWDLLIKQWVCDPLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1473 - protein, 252 aa, Artificial sequence
  Synthetic peptide
MSADCYFDILTKSDVCTSSGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1474 - protein, 252 aa, Artificial sequence
  Synthetic peptide
MSDDCMYDQLTRMFICSNLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1475 - protein, 252 aa, Artificial sequence
  Synthetic peptide
MDLNCKYDELTYKEWCQFNGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1476 - protein, 252 aa, Artificial sequence
  Synthetic peptide
MFHDCKYDLLTRQMVCHGLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1477 - protein, 252 aa, Artificial sequence
  Synthetic peptide
MRNHCFWDHLLKQDICPSPGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1478 - protein, 252 aa, Artificial sequence
  Synthetic peptide
MANQCWWDSLTKKNVCEFFGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1479 - protein, 252 aa, Artificial sequence
  Synthetic peptide
MFHDCKWDLLTKQWVCHGLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1480 - protein, 293 aa, Artificial sequence
  Synthetic peptide
MLPGCKWDLLIKQWVCDPLGSGSATGGSGSTASSGSGSATHMLPGCKWDLLIKQWVCDPLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1481 - protein, 293 aa, Artificial sequence
  Synthetic peptide
MFHDCKWDLLTKQWVCHGLGSGSATGGSGSTASSGSGSATHMFHDCKWDLLTKQWVCHGLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1482 - protein, 20 aa, Artificial sequence
  Synthetic peptide
PIRQEECDWDPWTCEHMWEV

SEQ ID NO: 1483 - protein, 20 aa, Artificial sequence
  Synthetic peptide
TNIQEECEWDPWTCDHMPGK

SEQ ID NO: 1484 - protein, 20 aa, Artificial sequence
  Synthetic peptide
WYEQDACEWDPWTCEHMAEV

SEQ ID NO: 1485 - protein, 20 aa, Artificial sequence
  Synthetic peptide
NRLQEVCEWDPWTCEHMENV

SEQ ID NO: 1486 - protein, 20 aa, Artificial sequence
  Synthetic peptide
AATQEECEWDPWTCEHMPRS

SEQ ID NO: 1487 - protein, 20 aa, Artificial sequence
  Synthetic peptide
LRHQEGCEWDPWTCEHMFDW

SEQ ID NO: 1488 - protein, 20 aa, Artificial sequence
  Synthetic peptide
VPRQKDCEWDPWTCEHMYVG

SEQ ID NO: 1489 - protein, 20 aa, Artificial sequence
  Synthetic peptide
SISHEECEWDPWTCEHMQVG

SEQ ID NO: 1490 - protein, 20 aa, Artificial sequence
  Synthetic peptide
WAAQEECEWDPWTCEHMGRM

SEQ ID NO: 1491 - protein, 20 aa, Artificial sequence
  Synthetic peptide
TWPQDKCEWDPWTCEHMGST

SEQ ID NO: 1492 - protein, 20 aa, Artificial sequence
  Synthetic peptide
GHSQEECGWDPWTCEHMGTS

SEQ ID NO: 1493 - protein, 20 aa, Artificial sequence
  Synthetic peptide
QHWQEECEWDPWTCDHMPSK

SEQ ID NO: 1494 - protein, 20 aa, Artificial sequence
  Synthetic peptide
NVRQEKCEWDPWTCEHMPVR

SEQ ID NO: 1495 - protein, 20 aa, Artificial sequence
  Synthetic peptide
KSGQVECNWDPWTCEHMPRN

SEQ ID NO: 1496 - protein, 20 aa, Artificial sequence
  Synthetic peptide
VKTQEHCDWDPWTCEHMREW

SEQ ID NO: 1497 - protein, 20 aa, Artificial sequence
  Synthetic peptide
AWGQEGCDWDPWTCEHMLPM

SEQ ID NO: 1498 - protein, 20 aa, Artificial sequence
  Synthetic peptide
PVNQEDCEWDPWTCEHMPPM

SEQ ID NO: 1499 - protein, 20 aa, Artificial sequence
  Synthetic peptide
RAPQEDCEWDPWTCAHMDIK

SEQ ID NO: 1500 - protein, 20 aa, Artificial sequence
  Synthetic peptide
HGQNMECEWDPWTCEHMFRY

SEQ ID NO: 1501 - protein, 20 aa, Artificial sequence
  Synthetic peptide
PRLQEECVWDPWTCEHMPLR

SEQ ID NO: 1502 - protein, 20 aa, Artificial sequence
  Synthetic peptide
RTTQEKCEWDPWTCEHMESQ

SEQ ID NO: 1503 - protein, 20 aa, Artificial sequence
  Synthetic peptide
QTSQEDCVWDPWTCDHMVSS

SEQ ID NO: 1504 - protein, 20 aa, Artificial sequence
  Synthetic peptide
QVIGRPCEWDPWTCEHLEGL

SEQ ID NO: 1505 - protein, 20 aa, Artificial sequence
  Synthetic peptide
WAQQEECAWDPWTCDHMVGL

SEQ ID NO: 1506 - protein, 20 aa, Artificial sequence
  Synthetic peptide
LPGQEDCEWDPWTCEHMVRS

SEQ ID NO: 1507 - protein, 20 aa, Artificial sequence
  Synthetic peptide
PMNQVECDWDPWTCEHMPRS

SEQ ID NO: 1508 - protein, 20 aa, Artificial sequence
  Synthetic peptide
FGWSHGCEWDPWTCEHMGST

SEQ ID NO: 1509 - protein, 20 aa, Artificial sequence
  Synthetic peptide
KSTQDDCDWDPWTCEHMVGP

SEQ ID NO: 1510 - protein, 20 aa, Artificial sequence
  Synthetic peptide
GPRISTCQWDPWTCEHMDQL

SEQ ID NO: 1511 - protein, 20 aa, Artificial sequence
  Synthetic peptide
STIGDMCEWDPWTCAHMQVD

SEQ ID NO: 1512 - protein, 20 aa, Artificial sequence
  Synthetic peptide
VLGGQGCEWDPWTCRLLQGW

SEQ ID NO: 1513 - protein, 20 aa, Artificial sequence
  Synthetic peptide
VLGGQGCQWDPWTCSHLEDG

SEQ ID NO: 1514 - protein, 20 aa, Artificial sequence
  Synthetic peptide
TTIGSMCEWDPWTCAHMQGG

SEQ ID NO: 1515 - protein, 20 aa, Artificial sequence
  Synthetic peptide
TKGKSVCQWDPWTCSHMQSG

SEQ ID NO: 1516 - protein, 20 aa, Artificial sequence
  Synthetic peptide
TTIGSMCQWDPWTCAHMQGG

SEQ ID NO: 1517 - protein, 20 aa, Artificial sequence
  Synthetic peptide
WVNEVVCEWDPWTCNHWDTP

SEQ ID NO: 1518 - protein, 20 aa, Artificial sequence
  Synthetic peptide
VVQVGMCQWDPWTCKHMRLQ

SEQ ID NO: 1519 - protein, 20 aa, Artificial sequence
  Synthetic peptide
AVGSQTCEWDPWTCAHLVEV

SEQ ID NO: 1520 - protein, 20 aa, Artificial sequence
  Synthetic peptide
QGMKMFCEWDPWTCAHIVYR

SEQ ID NO: 1521 - protein, 20 aa, Artificial sequence
  Synthetic peptide
TTIGSMCQWDPWTCEHMQGG

SEQ ID NO: 1522 - protein, 20 aa, Artificial sequence
  Synthetic peptide
TSQRVGCEWDPWTCQHLTYT

SEQ ID NO: 1523 - protein, 20 aa, Artificial sequence
  Synthetic peptide
QWSWPPCEWDPWTCQTVWPS

SEQ ID NO: 1524 - protein, 20 aa, Artificial sequence
  Synthetic peptide
GTSPSFCQWDPWTCSHMVQG

SEQ ID NO: 1525 - protein, 14 aa, Artificial sequence
  Synthetic peptide
QEECEWDPWTCEHM

SEQ ID NO: 1526 - protein, 22 aa, Artificial sequence
  Synthetic peptide
QNYKPLDELDATLYEHFIFHYT

SEQ ID NO: 1527 - protein, 22 aa, Artificial sequence
  Synthetic peptide
LNFTPLDELEQTLYEQWTLQQS

SEQ ID NO: 1528 - protein, 22 aa, Artificial sequence
  Synthetic peptide
TKFNPLDELEQTLYEQWTLQHQ

SEQ ID NO: 1529 - protein, 22 aa, Artificial sequence
  Synthetic peptide
VKFKPLDALEQTLYEHWMFQQA

SEQ ID NO: 1530 - protein, 22 aa, Artificial sequence
  Synthetic peptide
VKYKPLDELDEILYEQQTFQER

SEQ ID NO: 1531 - protein, 22 aa, Artificial sequence
  Synthetic peptide
TNFMPMDDLEQRLYEQFILQQG

SEQ ID NO: 1532 - protein, 22 aa, Artificial sequence
  Synthetic peptide
SKFKPLDELEQTLYEQWTLQHA

SEQ ID NO: 1533 - protein, 22 aa, Artificial sequence
  Synthetic peptide
QKFQPLDELEQTLYEQFMLQQA

SEQ ID NO: 1534 - protein, 22 aa, Artificial sequence
  Synthetic peptide
QNFKPMDELEDTLYKQFLFQHS

SEQ ID NO: 1535 - protein, 22 aa, Artificial sequence
  Synthetic peptide
YKFTPLDDLEQTLYEQWTLQHV

SEQ ID NO: 1536 - protein, 22 aa, Artificial sequence
  Synthetic peptide
QEYEPLDELDETLYNQWMFHQR

SEQ ID NO: 1537 - protein, 22 aa, Artificial sequence
  Synthetic peptide
SNFMPLDELEQTLYEQFMLQHQ

SEQ ID NO: 1538 - protein, 22 aa, Artificial sequence
  Synthetic peptide
QKYQPLDELDKTLYDQFMLQQG

SEQ ID NO: 1539 - protein, 22 aa, Artificial sequence
  Synthetic peptide
QKFQPLDELEETLYKQWTLQQR

SEQ ID NO: 1540 - protein, 22 aa, Artificial sequence
  Synthetic peptide
VKYKPLDELDEWLYHQFTLHHQ

SEQ ID NO: 1541 - protein, 22 aa, Artificial sequence
  Synthetic peptide
QKFMPLDELDEILYEQFMFQQS

SEQ ID NO: 1542 - protein, 22 aa, Artificial sequence
  Synthetic peptide
QTFQPLDDLEEYLYEQWIRRYH

SEQ ID NO: 1543 - protein, 22 aa, Artificial sequence
  Synthetic peptide
EDYMPLDALDAQLYEQFILLHG

SEQ ID NO: 1544 - protein, 22 aa, Artificial sequence
  Synthetic peptide
HTFQPLDELEETLYYQWLYDQL

SEQ ID NO: 1545 - protein, 22 aa, Artificial sequence
  Synthetic peptide
YKFNPMDELEQTLYEEFLFQHA

SEQ ID NO: 1546 - protein, 22 aa, Artificial sequence
  Synthetic peptide
TNYKPLDELDATLYEHWILQHS

SEQ ID NO: 1547 - protein, 22 aa, Artificial sequence
  Synthetic peptide
QKFKPLDELEQTLYEQWTLQQR

SEQ ID NO: 1548 - protein, 22 aa, Artificial sequence
  Synthetic peptide
TKFQPLDELDQTLYEQWTLQQR

SEQ ID NO: 1549 - protein, 22 aa, Artificial sequence
  Synthetic peptide
TNFQPLDELDQTLYEQWTLQQR

SEQ ID NO: 1550 - protein, 20 aa, Artificial sequence
  Synthetic peptide
KFNPLDELEETLYEQFTFQQ

SEQ ID NO: 1551 - protein, 20 aa, Artificial sequence
  Synthetic peptide
AGGMRPYDGMLGWPNYDVQA

SEQ ID NO: 1552 - protein, 20 aa, Artificial sequence
  Synthetic peptide
QTWDDPCMHILGPVTWRRCI

SEQ ID NO: 1553 - protein, 20 aa, Artificial sequence
  Synthetic peptide
APGQRPYDGMLGWPTYQRIV

SEQ ID NO: 1554 - protein, 20 aa, Artificial sequence
  Synthetic peptide
SGQLRPCEEIFGCGTQNLAL

SEQ ID NO: 1555 - protein, 20 aa, Artificial sequence
  Synthetic peptide
FGDKRPLECMFGGPIQLCPR

SEQ ID NO: 1556 - protein, 20 aa, Artificial sequence
  Synthetic peptide
GQDLRPCEDMFGCGTKDWYG

SEQ ID NO: 1557 - protein, 14 aa, Artificial sequence
  Synthetic peptide
KRPCEEIFGGCTYQ

SEQ ID NO: 1558 - protein, 20 aa, Artificial sequence
  Synthetic peptide
GFEYCDGMEDPFTFGCDKQT

SEQ ID NO: 1559 - protein, 20 aa, Artificial sequence
  Synthetic peptide
KLEYCDGMEDPFTQGCDNQS

SEQ ID NO: 1560 - protein, 20 aa, Artificial sequence
  Synthetic peptide
LQEWCEGVEDPFTFGCEKQR

SEQ ID NO: 1561 - protein, 20 aa, Artificial sequence
  Synthetic peptide
AQDYCEGMEDPFTFGCEMQK

SEQ ID NO: 1562 - protein, 20 aa, Artificial sequence
  Synthetic peptide
LLDYCEGVQDPFTFGCENLD

SEQ ID NO: 1563 - protein, 20 aa, Artificial sequence
  Synthetic peptide
HQEYCEGMEDPFTFGCEYQG

SEQ ID NO: 1564 - protein, 20 aa, Artificial sequence
  Synthetic peptide
MLDYCEGMDDPFTFGCDKQM

SEQ ID NO: 1565 - protein, 20 aa, Artificial sequence
  Synthetic peptide
LQDYCEGVEDPFTFGCENQR

SEQ ID NO: 1566 - protein, 20 aa, Artificial sequence
  Synthetic peptide
LQDYCEGVEDPFTFGCEKQR

SEQ ID NO: 1567 - protein, 18 aa, Artificial sequence
  Synthetic peptide
FDYCEGVEDPFTFGCDNH

SEQ ID NO: 1568 - protein, 14 aa, Artificial sequence
  Synthetic peptide
KRPCEEMWGGCNYD

SEQ ID NO: 1569 - protein, 14 aa, Artificial sequence
  Synthetic peptide
HQICKWDPWTCKHW

SEQ ID NO: 1570 - protein, 14 aa, Artificial sequence
  Synthetic peptide
KRPCEEIFGGCTYQ

SEQ ID NO: 1571 - protein, 14 aa, Artificial sequence
  Synthetic peptide
QEECEWDPWTCEHM

SEQ ID NO: 1572 - protein, 18 aa, Artificial sequence
  Synthetic peptide
FDYCEGVEDPFTFGCDNH

SEQ ID NO: 1573 - protein, 20 aa, Artificial sequence
  Synthetic peptide
KFNPLDELEETLYEQFTFQQ

SEQ ID NO: 1574 - protein, 14 aa, Artificial sequence
  Synthetic peptide
QYGCDGFLYGCMIN

SEQ ID NO: 1575 - protein, 31 aa, Artificial sequence
  Synthetic peptide
MGAQKFNPLDELEETLYEQFTFQQLEGGGGG

SEQ ID NO: 1576 - protein, 28 aa, Artificial sequence
  Synthetic peptide
MKFNPLDELEETLYEQFTFQQLEGGGGG

SEQ ID NO: 1577 - protein, 50 aa, Artificial sequence
  Synthetic peptide
MKFNPLDELEETLYEQFTFQQGSGSATGGSGSTASSGSGSATHLEGGGGG

SEQ ID NO: 1578 - protein, 59 aa, Artificial sequence
  Synthetic peptide
MGAQKFNPLDELEETLYEQFTFQQGGGGGGGGKFNPLDELEETLYEQFTFQQLEGGGGG

SEQ ID NO: 1579 - protein, 55 aa, Artificial sequence
  Synthetic peptide
MKFNPLDELEETLYEQFTFQQGGGGGGGKFNPLDELEETLYEQFTFQQLEGGGGG

SEQ ID NO: 1580 - protein, 25 aa, Artificial sequence
  Synthetic peptide
MGAQQEECEWDPWTCEHMLEGGGGG

SEQ ID NO: 1581 - protein, 44 aa, Artificial sequence
  Synthetic peptide
MQEECEWDPWTCEHMGSGSATGGSGSTASSGSGSATHLEGGGGG

SEQ ID NO: 1582 - protein, 61 aa, Artificial sequence
  Synthetic peptide
MGAQQEECEWDPWTCEHMGSGSATGGSGSTASSGSGSATHQEECEWDPWTCEHMLEGGGGG

SEQ ID NO: 1583 - protein, 29 aa, Artificial sequence
  Synthetic peptide
GGGGGAQKFNPLDELEETLYEQFTFQQLE

SEQ ID NO: 1584 - protein, 51 aa, Artificial sequence
  Synthetic peptide
GGGGGAQGSGSATGGSGSTASSGSGSATHKFNPLDELEETLYEQFTFQQLE

SEQ ID NO: 1585 - protein, 57 aa, Artificial sequence
  Synthetic peptide
GGGGGAQKFNPLDELEETLYEQFTFQQGGGGGGGGKFNPLDELEETLYEQFTFQQLE

SEQ ID NO: 1586 - protein, 23 aa, Artificial sequence
  Synthetic peptide
GGGGGAQQEECEWDPWTCEHMLE

SEQ ID NO: 1587 - protein, 45 aa, Artificial sequence
  Synthetic peptide
GGGGGAQGSGSATGGSGSTASSGSGSATHQEECEWDPWTCEHMLE

SEQ ID NO: 1588 - protein, 59 aa, Artificial sequence
  Synthetic peptide
GGGGGAQQEECEWDPWTCEHMGSGSATGGSGSTASSGSGSATHQEECEWDPWTCEHMLE

SEQ ID NO: 1589 - protein, 74 aa, Artificial sequence
  Synthetic peptide
MGAQEECEWDPWTCEHMGGGGGGGGKFNPLDELEETLYEQFTFQQGSGSATGGSGSTASSGSGSATHLEGGGGG

SEQ ID NO: 1590 - protein, 70 aa, Artificial sequence
  Synthetic peptide
GGGGGAQGSGSATGGSGSTASSGSGSATHKFNPLDELEETLYEQFTFQQGGGGGQEECEWDPWTCEHMLE

SEQ ID NO: 1591 - protein, 29 aa, Artificial sequence
  Synthetic peptide
MGAQFDYCEGVEDPFTFGCDNHLEGGGGG

SEQ ID NO: 1592 - protein, 25 aa, Artificial sequence
  Synthetic peptide
MGAQQYGCDGFLYGCMINLEGGGGG

SEQ ID NO: 1593 - protein, 25 aa, Artificial sequence
  Synthetic peptide
MGAQKRPCEEMWGGCNYDLEGGGGG

SEQ ID NO: 1594 - protein, 25 aa, Artificial sequence
  Synthetic peptide
MGAQHQICKWDPWTCKHWLEGGGGG

SEQ ID NO: 1595 - protein, 25 aa, Artificial sequence
  Synthetic peptide
MGAQKRPCEEIFGGCTYQLEGGGGG

SEQ ID NO: 1596 - protein, 29 aa, Artificial sequence
  Synthetic peptide
GGGGGAQPIRQEECDWDPWTCEHMWEVLE

SEQ ID NO: 1597 - protein, 29 aa, Artificial sequence
  Synthetic peptide
GGGGGAQTNIQEECEWDPWTCDHMPGKLE

SEQ ID NO: 1598 - protein, 29 aa, Artificial sequence
  Synthetic peptide
GGGGGAQWYEQDACEWDPWTCEHMAEVLE

SEQ ID NO: 1599 - protein, 29 aa, Artificial sequence
  Synthetic peptide
GGGGGAQNRLQEVCEWDPWTCEHMENVLE

SEQ ID NO: 1600 - protein, 29 aa, Artificial sequence
  Synthetic peptide
GGGGGAQAATQEECEWDPWTCEHMPRSLE

SEQ ID NO: 1601 - protein, 29 aa, Artificial sequence
  Synthetic peptide
GGGGGAQLRHQEGCEWDPWTCEHMFDWLE

SEQ ID NO: 1602 - protein, 29 aa, Artificial sequence
  Synthetic peptide
GGGGGAQVPRQKDCEWDPWTCEHMYVGLE

SEQ ID NO: 1603 - protein, 29 aa, Artificial sequence
  Synthetic peptide
GGGGGAQSISHEECEWDPWTCEHMQVGLE

SEQ ID NO: 1604 - protein, 29 aa, Artificial sequence
  Synthetic peptide
GGGGGAQWAAQEECEWDPWTCEHMGRMLE

SEQ ID NO: 1605 - protein, 29 aa, Artificial sequence
  Synthetic peptide
GGGGGAQTWPQDKCEWDPWTCEHMGSTLE

SEQ ID NO: 1606 - protein, 29 aa, Artificial sequence
  Synthetic peptide
GGGGGAQGHSQEECGWDPWTCEHMGTSLE

SEQ ID NO: 1607 - protein, 29 aa, Artificial sequence
  Synthetic peptide
GGGGGAQQHWQEECEWDPWTCDHMPSKLE

SEQ ID NO: 1608 - protein, 29 aa, Artificial sequence
  Synthetic peptide
GGGGGAQNVRQEKCEWDPWTCEHMPVRLE

SEQ ID NO: 1609 - protein, 29 aa, Artificial sequence
  Synthetic peptide
GGGGGAQKSGQVECNWDPWTCEHMPRNLE

SEQ ID NO: 1610 - protein, 29 aa, Artificial sequence
  Synthetic peptide
GGGGGAQVKTQEHCDWDPWTCEHMREWLE

SEQ ID NO: 1611 - protein, 29 aa, Artificial sequence
  Synthetic peptide
GGGGGAQAWGQEGCDWDPWTCEHMLPMLE

SEQ ID NO: 1612 - protein, 29 aa, Artificial sequence
  Synthetic peptide
GGGGGAQPVNQEDCEWDPWTCEHMPPMLE

SEQ ID NO: 1613 - protein, 29 aa, Artificial sequence
  Synthetic peptide
GGGGGAQRAPQEDCEWDPWTCAHMDIKLE

SEQ ID NO: 1614 - protein, 29 aa, Artificial sequence
  Synthetic peptide
GGGGGAQHGQNMECEWDPWTCEHMFRYLE

SEQ ID NO: 1615 - protein, 29 aa, Artificial sequence
  Synthetic peptide
GGGGGAQPRLQEECVWDPWTCEHMPLRLE

SEQ ID NO: 1616 - protein, 29 aa, Artificial sequence
  Synthetic peptide
GGGGGAQRTTQEKCEWDPWTCEHMESQLE

SEQ ID NO: 1617 - protein, 29 aa, Artificial sequence
  Synthetic peptide
GGGGGAQQTSQEDCVWDPWTCDHMVSSLE

SEQ ID NO: 1618 - protein, 29 aa, Artificial sequence
  Synthetic peptide
GGGGGAQQVIGRPCEWDPWTCEHLEGLLE

SEQ ID NO: 1619 - protein, 29 aa, Artificial sequence
  Synthetic peptide
GGGGGAQWAQQEECAWDPWTCDHMVGLLE

SEQ ID NO: 1620 - protein, 29 aa, Artificial sequence
  Synthetic peptide
GGGGGAQLPGQEDCEWDPWTCEHMVRSLE

SEQ ID NO: 1621 - protein, 29 aa, Artificial sequence
  Synthetic peptide
GGGGGAQPMNQVECDWDPWTCEHMPRSLE

SEQ ID NO: 1622 - protein, 29 aa, Artificial sequence
  Synthetic peptide
GGGGGAQFGWSHGCEWDPWTCEHMGSTLE

SEQ ID NO: 1623 - protein, 29 aa, Artificial sequence
  Synthetic peptide
GGGGGAQKSTQDDCDWDPWTCEHMVGPLE

SEQ ID NO: 1624 - protein, 29 aa, Artificial sequence
  Synthetic peptide
GGGGGAQGPRISTCQWDPWTCEHMDQLLE

SEQ ID NO: 1625 - protein, 29 aa, Artificial sequence
  Synthetic peptide
GGGGGAQSTIGDMCEWDPWTCAHMQVDLE

SEQ ID NO: 1626 - protein, 29 aa, Artificial sequence
  Synthetic peptide
GGGGGAQVLGGQGCEWDPWTCRLLQGWLE

SEQ ID NO: 1627 - protein, 29 aa, Artificial sequence
  Synthetic peptide
GGGGGAQVLGGQGCQWDPWTCSHLEDGLE

SEQ ID NO: 1628 - protein, 29 aa, Artificial sequence
  Synthetic peptide
GGGGGAQTTIGSMCEWDPWTCAHMQGGLE

SEQ ID NO: 1629 - protein, 29 aa, Artificial sequence
  Synthetic peptide
GGGGGAQTKGKSVCQWDPWTCSHMQSGLE

SEQ ID NO: 1630 - protein, 29 aa, Artificial sequence
  Synthetic peptide
GGGGGAQTTIGSMCQWDPWTCAHMQGGLE

SEQ ID NO: 1631 - protein, 29 aa, Artificial sequence
  Synthetic peptide
GGGGGAQWVNEVVCEWDPWTCNHWDTPLE

SEQ ID NO: 1632 - protein, 29 aa, Artificial sequence
  Synthetic peptide
GGGGGAQVVQVGMCQWDPWTCKHMRLQLE

SEQ ID NO: 1633 - protein, 29 aa, Artificial sequence
  Synthetic peptide
GGGGGAQAVGSQTCEWDPWTCAHLVEVLE

SEQ ID NO: 1634 - protein, 29 aa, Artificial sequence
  Synthetic peptide
GGGGGAQQGMKMFCEWDPWTCAHIVYRLE

SEQ ID NO: 1635 - protein, 29 aa, Artificial sequence
  Synthetic peptide
GGGGGAQTTIGSMCQWDPWTCEHMQGGLE

SEQ ID NO: 1636 - protein, 29 aa, Artificial sequence
  Synthetic peptide
GGGGGAQTSQRVGCEWDPWTCQHLTYTLE

SEQ ID NO: 1637 - protein, 29 aa, Artificial sequence
  Synthetic peptide
GGGGGAQQWSWPPCEWDPWTCQTVWPSLE

SEQ ID NO: 1638 - protein, 29 aa, Artificial sequence
  Synthetic peptide
GGGGGAQGTSPSFCQWDPWTCSHMVQGLE

SEQ ID NO: 1639 - protein, 29 aa, Artificial sequence
  Synthetic peptide
GGGGGAQTQGLHQCEWDPWTCKVLWPSLE

SEQ ID NO: 1640 - protein, 29 aa, Artificial sequence
  Synthetic peptide
GGGGGAQVWRSQVCQWDPWTCNLGGDWLE

SEQ ID NO: 1641 - protein, 29 aa, Artificial sequence
  Synthetic peptide
GGGGGAQDKILEECQWDPWTCQFFYGALE

SEQ ID NO: 1642 - protein, 29 aa, Artificial sequence
  Synthetic peptide
GGGGGAQATFARQCQWDPWTCALGGNWLE

SEQ ID NO: 1643 - protein, 29 aa, Artificial sequence
  Synthetic peptide
GGGGGAQGPAQEECEWDPWTCEPLPLMLE

SEQ ID NO: 1644 - protein, 29 aa, Artificial sequence
  Synthetic peptide
GGGGGAQRPEDMCSQWDPWTWHLQGYCLE

SEQ ID NO: 1645 - protein, 29 aa, Artificial sequence
  Synthetic peptide
GGGGGAQLWQLAVCQWDPQTCDHMGALLE

SEQ ID NO: 1646 - protein, 29 aa, Artificial sequence
  Synthetic peptide
GGGGGAQTQLVSLCEWDPWTCRLLDGWLE

SEQ ID NO: 1647 - protein, 29 aa, Artificial sequence
  Synthetic peptide
GGGGGAQMGGAGRCEWDPWTCQLLQGWLE

SEQ ID NO: 1648 - protein, 29 aa, Artificial sequence
  Synthetic peptide
GGGGGAQMFLPNECQWDPWTCSNLPEALE

SEQ ID NO: 1649 - protein, 29 aa, Artificial sequence
  Synthetic peptide
GGGGGAQFGWSHGCEWDPWTCRLLQGWLE

SEQ ID NO: 1650 - protein, 29 aa, Artificial sequence
  Synthetic peptide
GGGGGAQWPQTEGCQWDPWTCRLLHGWLE

SEQ ID NO: 1651 - protein, 29 aa, Artificial sequence
  Synthetic peptide
GGGGGAQPDTRQGCQWDPWTCRLYGMWLE

SEQ ID NO: 1652 - protein, 29 aa, Artificial sequence
  Synthetic peptide
GGGGGAQTWPQDKCEWDPWTCRLLQGWLE

SEQ ID NO: 1653 - protein, 29 aa, Artificial sequence
  Synthetic peptide
GGGGGAQDKILEECEWDPWTCRLLQGWLE

SEQ ID NO: 1654 - protein, 29 aa, Artificial sequence
  Synthetic peptide
GGGGGAQAATQEECEWDPWTCRLLQGWLE

SEQ ID NO: 1655 - protein, 33 aa, Artificial sequence
  Synthetic peptide
MGAQTNFMPMDDLEQRLYEQFILQQGLEGGGGG

SEQ ID NO: 1656 - protein, 33 aa, Artificial sequence
  Synthetic peptide
MGAQTNYKPLDELDATLYEHWILQHSLEGGGGG

SEQ ID NO: 1657 - protein, 33 aa, Artificial sequence
  Synthetic peptide
MGAQQKYQPLDELDKTLYDQFMLQQGLEGGGGG

SEQ ID NO: 1658 - protein, 33 aa, Artificial sequence
  Synthetic peptide
MGAQLNFTPLDELEQTLYEQWTLQQSLEGGGGG

SEQ ID NO: 1659 - protein, 33 aa, Artificial sequence
  Synthetic peptide
MGAQQKFQPLDELEQTLYEQFMLQQALEGGGGG

SEQ ID NO: 1660 - protein, 33 aa, Artificial sequence
  Synthetic peptide
MGAQQEYEPLDELDETLYNQWMFHQRLEGGGGG

SEQ ID NO: 1661 - protein, 33 aa, Artificial sequence
  Synthetic peptide
MGAQVKYKPLDELDEILYEQQTFQERLEGGGGG

SEQ ID NO: 1662 - protein, 33 aa, Artificial sequence
  Synthetic peptide
MGAQTKFQPLDELDQTLYEQWTLQQRLEGGGGG

SEQ ID NO: 1663 - protein, 33 aa, Artificial sequence
  Synthetic peptide
MGAQTNFQPLDELDQTLYEQWTLQQRLEGGGGG

SEQ ID NO: 1664 - protein, 33 aa, Artificial sequence
  Synthetic peptide
MGAQQNFKPMDELEDTLYKQFLFQHSLEGGGGG

SEQ ID NO: 1665 - protein, 33 aa, Artificial sequence
  Synthetic peptide
MGAQVKYKPLDELDEWLYHQFTLHHQLEGGGGG

SEQ ID NO: 1666 - protein, 33 aa, Artificial sequence
  Synthetic peptide
MGAQYKFTPLDDLEQTLYEQWTLQHVLEGGGGG

SEQ ID NO: 1667 - protein, 33 aa, Artificial sequence
  Synthetic peptide
MGAQQNYKPLDELDATLYEHFIFHYTLEGGGGG

SEQ ID NO: 1668 - protein, 33 aa, Artificial sequence
  Synthetic peptide
MGAQVKFKPLDALEQTLYEHWMFQQALEGGGGG

SEQ ID NO: 1669 - protein, 33 aa, Artificial sequence
  Synthetic peptide
MGAQEDYMPLDALDAQLYEQFILLHGLEGGGGG

SEQ ID NO: 1670 - protein, 33 aa, Artificial sequence
  Synthetic peptide
MGAQYKFNPMDELEQTLYEEFLFQHALEGGGGG

SEQ ID NO: 1671 - protein, 33 aa, Artificial sequence
  Synthetic peptide
MGAQSNFMPLDELEQTLYEQFMLQHQLEGGGGG

SEQ ID NO: 1672 - protein, 33 aa, Artificial sequence
  Synthetic peptide
MGAQQKFQPLDELEETLYKQWTLQQRLEGGGGG

SEQ ID NO: 1673 - protein, 33 aa, Artificial sequence
  Synthetic peptide
MGAQQKFMPLDELDEILYEQFMFQQSLEGGGGG

SEQ ID NO: 1674 - protein, 33 aa, Artificial sequence
  Synthetic peptide
MGAQTKFNPLDELEQTLYEQWTLQHQLEGGGGG

SEQ ID NO: 1675 - protein, 33 aa, Artificial sequence
  Synthetic peptide
MGAQHTFQPLDELEETLYYQWLYDQLLEGGGGG

SEQ ID NO: 1676 - protein, 33 aa, Artificial sequence
  Synthetic peptide
MGAQQKFKPLDELEQTLYEQWTLQQRLEGGGGG

SEQ ID NO: 1677 - protein, 33 aa, Artificial sequence
  Synthetic peptide
MGAQQTFQPLDDLEEYLYEQWIRRYHLEGGGGG

SEQ ID NO: 1678 - protein, 33 aa, Artificial sequence
  Synthetic peptide
MGAQSKFKPLDELEQTLYEQWTLQHALEGGGGG

SEQ ID NO: 1679 - protein, 29 aa, Artificial sequence
  Synthetic peptide
GGGGGAQSGQLRPCEEIFGCGTQNLALLE

SEQ ID NO: 1680 - protein, 29 aa, Artificial sequence
  Synthetic peptide
GGGGGAQAGGMRPYDGMLGWPNYDVQALE

SEQ ID NO: 1681 - protein, 29 aa, Artificial sequence
  Synthetic peptide
GGGGGAQGQDLRPCEDMFGCGTKDWYGLE

SEQ ID NO: 1682 - protein, 29 aa, Artificial sequence
  Synthetic peptide
GGGGGAQAPGQRPYDGMLGWPTYQRIVLE

SEQ ID NO: 1683 - protein, 29 aa, Artificial sequence
  Synthetic  peptide
GGGGGAQQTWDDPCMHILGPVTWRRCILE

SEQ ID NO: 1684 - protein, 29 aa, Artificial sequence
  Synthetic peptide
GGGGGAQFGDKRPLECMFGGPIQLCPRLE

SEQ ID NO: 1685 - protein, 23 aa, Artificial sequence
  Synthetic peptide
GGGGGAQKRPCEEIFGGCTYQLE

SEQ ID NO: 1686 - protein, 29 aa, Artificial sequence
  Synthetic peptide
GGGGGAQLQEWCEGVEDPFTFGCEKQRLE

SEQ ID NO: 1687 - protein, 29 aa, Artificial sequence
  Synthetic peptide
GGGGGAQMLDYCEGMDDPFTFGCDKQMLE

SEQ ID NO: 1688 - protein, 29 aa, Artificial sequence
  Synthetic peptide
GGGGGAQHQEYCEGMEDPFTFGCEYQGLE

SEQ ID NO: 1689 - protein, 29 aa, Artificial sequence
  Synthetic peptide
GGGGGAQLQDYCEGVEDPFTFGCENQRLE

SEQ ID NO: 1690 - protein, 29 aa, Artificial sequence
  Synthetic peptide
GGGGGAQLLDYCEGVQDPFTFGCENLDLE

SEQ ID NO: 1691 - protein, 29 aa, Artificial sequence
  Synthetic peptide
GGGGGAQGFEYCDGMEDPFTFGCDKQTLE

SEQ ID NO: 1692 - protein, 29 aa, Artificial sequence
  Synthetic peptide
GGGGGAQAQDYCEGMEDPFTFGCEMQKLE

SEQ ID NO: 1693 - protein, 29 aa, Artificial sequence
  Synthetic peptide
GGGGGAQLQDYCEGVEDPFTFGCEKQRLE

SEQ ID NO: 1694 - protein, 29 aa, Artificial sequence
  Synthetic peptide
GGGGGAQKLEYCDGMEDPFTQGCDNQSLE

SEQ ID NO: 1695 - protein, 27 aa, Artificial sequence
  Synthetic peptide
GGGGGAQFDYCEGVEDPFTFGCDNHLE

SEQ ID NO: 1696 - protein, 228 aa, Artificial sequence
  Synthetic peptide
VDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1697 - protein, 62 aa, Artificial sequence
  Synthetic peptide
GCKWDLLIKQWVCDPLGSGSATGGSGSTASSGSGSATHMLPGCKWDLLIKQWVCDPLGGGGG

SEQ ID NO: 1698 - protein, 290 aa, Artificial sequence
  Synthetic peptide
GCKWDLLIKQWVCDPLGSGSATGGSGSTASSGSGSATHMLPGCKWDLLIKQWVCDPLGGGGGVDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1699 - protein, 228 aa, Artificial sequence; identical to SEQ ID NO: 1696
  Synthetic peptide

SEQ ID NO: 1700 - protein, 27 aa, Artificial sequence
  Synthetic peptide
GGGGGAQLADHGQCIRWPWMCPPEGWE

SEQ ID NO: 1701 - protein, 255 aa, Artificial sequence
  Synthetic peptide
VDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGGAQLADHGQCIRWPWMCPPEGWE

SEQ ID NO: 1702 - protein, 4 aa, Artificial sequence
  Synthetic peptide
GGGG

SEQ ID NO: 1703 - protein, 5 aa, Artificial sequence
  Synthetic peptide
GGGGG

SEQ ID NO: 1704 - protein, 8 aa, Artificial sequence
  Synthetic peptide
GGGGGGGG

What is claimed is:

1. A stable lyophilized therapeutic peptibody composition comprising a buffer, a bulking agent, a stabilizing agent, and a surfactant wherein;
    said buffer is 10 mM histidine;
    the pH is 5.0;
    said bulking agent is 4% w/v mannitol;
    said stabilizing agent is 2% w/v sucrose;
    said surfactant is 0.004% w/v polysorbate-20; and
    said therapeutic peptibody is a dimer that comprises a structure of the formula $$F^1\text{-}(L^1)_e\text{-}P^1(L^2)_f\text{-}P^2$$

wherein:
    $F^1$ is an Fc domain, wherein the Fc domain is attached at the N-terminus of $-L^1-P^1-L^2-P^2$;
    $P^1$ and $P^2$ are each independently selected from Table 6;
    $L^1$ and $L^2$ are each independently linkers; and
    e and f are each independently 0 or 1.

2. The composition of claim 1 wherein $P^1$ and $P^2$ have the same amino acid sequence.

3. The composition of claim 1 wherein the Fc domain is set out in SEQ ID NO: 1.

4. The composition of claim 1 wherein the therapeutic peptibody concentration is between about 0.25 mg/mL and 250 mg/mL.

5. The composition of claim 1 wherein the therapeutic peptibody concentration is 0.5 mg/mL.

6. A kit for preparing an aqueous pharmaceutical composition comprising a first container having a stable lyophilized therapeutic peptibody composition of claim 1, and a second container having a physiologically acceptable solvent for the lyophilized composition.

7. The composition of claim 1, wherein the Fc domain is SEQ ID NO: 1 and wherein the peptibody comprises SEQ ID NO: 1017.

8. The composition of claim 7, wherein methionine is at the N-terminus of the peptibody, SEQ ID NO: 1 is at the C-terminus of said methionine and SEQ ID NO: 1017 is at the C-terminus of the peptibody.

* * * * *